United States Patent 7,867,704 (MYCOBACTERIAL DIAGNOSTICS) - sequence listing, part 4

SEQ ID NO: 3771 - protein, 1095 aa, Mycobacterium paratuberculosis
MPGTEQHLDYLKRLTADLRRTRRRVAELEGRLSEPVAVVGMACRYAGGVDSPEALWDLVIEGRDTVSDFPVDRGWDVEGLYDPDPDAKGKMYTRQGSFLQHAGDFDAGFFGIGPSEALAMDPQQRIMLEICWEALERAGIDPSALRGTATGVFAGVIHAGYGGEVKGELEGYGLTGSTLSVTSGRVSYVLGLEGPAVSVDTACSSSLVAMHLAAQSLRSGECDLALAGGVTVMATPAAFVEFSRQRALAPDGRCKVYAGAADGTSWSEGAGVLVLERLGDARRLGHPVWAVLRGSAVNQDGASNGLTAPNGPSQQRVIRAALANAGLSAVDVDVVEGHGTGTVLGDPIEAQALLATYGQDRPADRPLWLGSIKSNIGHTSAAAGVAGVIKMVQAIRHGVMPKTLHVDVPSPHVDWSAGAVSLLTDPRPWPEHGGPRRAGVSSFGISGTNAHVIVEQAPAAAETEAAPASSAMPDAVVPWVVSARSAEALAGQARRLLDHVTADAQASPLDVGWSLVSTRAVFEHRAVVVGCERGALATGLAGLASGRPDAATVVGRARATGKTVLVFPGQGSQTLGMGRQLYERFVVFARALDEAVAVVDEHSRLPVREVMWGADPELLQSTEFAQPALFVFEVALAALWESLGVTPDVVMGHSVGEIAAACVAGVLSLPDAARLVAARGALMAALPAGGVMVAVTAGEAQVAPLVGGGVSIAAVNGPDAVVLSGEQEAVAAVAERLAGSGARVHRLAVSHAFHSALMEPMLGGFAAAAAGIEPRPPRIPLVSNLTGQLAGPGYGTPQYWVEHVRAPVQFLAGVRAAEQAGAGTFLELGPGAALTAAVDQSLSTEGATAIATLPKDRPETESALHAAGHLFTRGHRLDWAGVFAGLPARRVELPTYAFARERFWLGGASLAGAPAGAAPVGGGTRAPELAHRLHALPRDEQQRVLRELVCEHAAAVLGHPDGDAIDPHRAFADLGFDSLIGVELRNRLTTHTGTALSRTLIFDYPTPTALADHLRRQLLHDEDPESDDERIWSALRRIPLRELRRTGLLDKLLLLAGIPETATTDPKISDADIDSLSPDALIAMALNSADDDEAE

SEQ ID NO: 3772 - protein, 2018 aa, Mycobacterium paratuberculosis
MPRSSGSHPVRRWRWTPSSGCCSRCPGKRWSGPELTPRTLRGSATGVFAGIFHGSYGGQGRVPGNLERYGLRGSTLSVASGRVAYALGLEGPAVSVDTACSSSLVALHLAAQSLRSGECDLALAGGVTVMATPAMFIEFSRQRALAADGRCKAYAGAADGTGFSEGVGVLVLERLSDARRLGHSVLAVLRGSAVNQDGASNGLATPNGPSQQRVIRAALANARLGAADVDLVEGHGTGTMLGDPIEAQALLATYGQDRPVDEPLWLGSIKSNMGHTSAAAGAGGVIKMVQALRHGVMPKTLHVDEPTPQVDWSAGAVSLLTEARPWPARDRPRRAGVSSFGISGTNAHVIVEQYEPETIAPQGGDVVVPWVLSARSAEALTNQAARLLARVKADPGVRVLDVGWSLVSTRSRFEHRAVIVGADGAQLLRRLADLAGGQPGAGVVTGRAQPVGKTVFVFPGQGSQWPGMGAQLLDRSTVFAEHMHRCAGALAEHVDWSLIDVIRGTPGAPGLDRVDVVQPALWAVMVSLAELWRSVGVVPDAVIGHSQGEIAAACVAGALSLQDAARVVALRSRLLVRLSGRGGMVSLACGRSRAEQLIAPWGERLNIATVNGISAVVVSGEVDALTELLDRCAADDIRARRIDVDYASHSVQVEEIRDSLAEALRGIAPRSSAVAFFSTVTGELMDTAALDGDYWFRSIRQTVQFERAVRGAAEAGYRAFIECSPHPVLTAAIEETMPDGGQGCVIPSLGRDDGGPDRFWLSAGQAFVSGVVVDWCAMLDGLGGRRVDLPTYGFVRQHFWLPGGSTGSSDVAALGLRGAEHGLLGAVLPRPDSGGVVLTGRLSTSAQAWLADHAVGDTVLFPGAGFVELAIRAGDEVGCGVIDELTLSAPLPLPASGGVRLQLVVGAPDEAGRRPLSVYSAAVHQDSEWMLHAEGVLRAGTVTPAGDLSIWPPIGATAVDVTGGYARLAQRGYEYGRAFRGLRAMWQRGDEIFAEVALPDDAAAGDDFGVHPVLLDAALHVLGVAGEKDQTVLPFSWQGVALHASGASRARVRIAPAGAGAVSVELADGAGLPVLSVRSVTMRPVSPGQLSAAMGTAQPSGLLDVIWSPIALGGNDLGDEVTLWEPGEHGGDVVKSVHAAVTETLAVLQSWLDGEGGGVLAVQTHGAVALAGEDVSDLAGAAVWGLVRSAQAEHPGRLVLIDSDGSLDARAVIPCGEPQVVVRQGVAHAARLRPARAGATLGLPSGAWRLDAGGEGTLGDLVVSRCPRTELADGQVRVAVAAVGVNFRDVLVALGMYPGGGRLGAEGAGVVVEVGPAVTGLAVGDPVMGLLGVVGSEAVVDQRLLTAVPPGLSLVAAAGVPVVFLTALYGLSVLAGLRPGERVLVHTATGGVGMAAVQLARHYGAEVFATASRGKWDTLRAMGFDDDHIGDSRSPDFEQKFLAATGGAGVDVVLNSLAGEFTDASLRLLAPGGRFIEMGKTDVRDPDVVAQRYRGARYRAFDLMEAGPDRTAAMLAEIVGLLQEGVLTPLPLKTFDVRCASAAYRYVSQARHIGKVVLTVPSGLGEVLSGCGGGLAQSTVLITGGTGMAGSALARHLVDRYRVGHVVLVSRTGAQAAGAAELVDELQRAGASASVLACDVADRDAVATMLAGLPAGYPLRGIVHAAGILDDGLLSSLIPDRVDAVLRAKVDGAWNLHELTKDLDLSAFVVFSSMAGIVGTPGQANYAAANSFLDGLVAHRRADGLAGLSLAWGLWEQASAMTAHLGDRDKARMSRIGLAPLSTEQALAAFDAAMLVETPVLVAARLDRAALSENIAALPPLLRELAAGPTRRVIDDADVTASMSGLAARLHGLSPEARRRELVDLVCGNAAMVLGVPNPADINAGRAFQDLGFDSLTAVELRNRLKNATGLTLSPTLIFDYPTPVVLAEHLDSRLAGSGGDDQPDLMGRFNDITRELQALLGAAHWNSDDKAVLRTRIHGLLGALPAGDGPDSAPLDEDLEAATESQLFAILDEELGR

SEQ ID NO: 3773 - protein, 351 aa, Mycobacterium paratuberculosis
MSGDTEELVRALRQSLKENERLKRENRRYLVAATEPVAVVGMGCRYPGGVDSPEALWEMVVEGRDVVSEFPADRGWDLAGLFDADPDAVGKSYCRCGGFLTGVGDFDAAFFGIAPSEALAMDPQQRLLLEVSWEALERAGIDPAHAARIGDRGVRRDIPRLLRRPGPGARKPGAIRPARLDAERGLGAGGLRAGPGRPGGLRRHRVFVVVGGAAPGGAVAALRRMRPGAGRRGDGDGHPGDVHRVQPAAGAGRRRPLQGLRGRRGRHRLLRRRRGAGAGAAERCTATGTFGAGGAARLRGQPGRRVQRPGHPQRAVAAAGDPGGAGQRPARRGRRGPGGRAWDGHHAGRSH

SEQ ID NO: 3774 - protein, 353 aa, Mycobacterium paratuberculosis
MSVIAGVFGALPPHRYPQRELTDFFVSIPEFEGYEDIVRQLHASAKVGSRHLVLPLEQYPTLTDFGVANRIFIEHAVTLGCAALSGALDEAGLKPEDLDVLITTTVTGLAVPSVDARIAARLGLRDDVRRVPLFGLGCVAGAAGVARMHDYLRGAPDAVAALVSVELCSLTYPGYKPSLAGLVGSALFADGAGAVVAVGERRAEQLDAAGPSVLDSRSHLYPDSLRTMGYDVGATGFELVLSKDVAAVVEQYIEDDVTGFLGAHGLTTNDIGAFVSHPGGPKVIEAINAALGLPPEALELTWRSLGEIGNLSSASVLHVLRDTLAKPPPSDSPGLMLAMGPGFCSELVLLRWH

SEQ ID NO: 3775 - protein, 472 aa, Mycobacterium paratuberculosis
VSTREGSLWGGRFADGPSDALAALSKSTHFDWVLAPYDIVASRAHTVILYRAGLLSEEQRDGLLAGLDSLAEDVADGSFTPLVTDEDVHAALERGLIDRVGPDLGGRLRAGRSRNDQVATLFRMWLRDAVRRVAAGALDVVGALVAQAAAHPEAIMPGKTHLQSAQPVLLAHHLLAHAHPLLRDVDRIVDFDKRAAVSPYGSGALAGSSLGLDPDAIAAELGFASAADNSIDATASRDFAAEAAFVFAMIGVDLSRLAEDVILWSSTEFGYVKLHDAWSTGSSIMPQKKNPDIAELARGKSGRLIGNLAGLLATLKAQPLAYNRDLQEDKEPVFDAVAQLELVLPAMAGLVGSLTFDVQRMAALAPAGYTLATDIAEWLVRQGVPFRSAHEAAGAAVRAAEQRAVGLDELTDDELAAISPALTPQVREVLTIEGSVSSRDARGGTAPARVAEQIDTVAATAARLRERLGGPA

SEQ ID NO: 3776 - protein, 398 aa, Mycobacterium paratuberculosis
MSERVILAYSGGLDTSVAISWIGKETGREVVAVAIDLGQGGEDMEVIRQRALDCGAVEAVVVDARDEFAEGYCLPTIRNNALYMDRYPLVSAISRPLIVKHLVAAAREHGGSTVAHGCTGKGNDQVRFEVGFASLAPDLEVLAPVRDYAWTREKAIAFAEENAIPINVTKRSPFSIDQNVWGRAVETGFLEHLWNAPTKDVYAYTEDPTLNWSTPDEVIVGFERGVPVSIDGKPVSVLGAIEELNARAGAKGVGRLDVVEDRLVGIKSREIYEAPGAMVLITAHTELEHVTLERELGRFKRHTDQRWAELVYDGLWYSPLKAALESFVDKTQEHVTGEIRMVLHGGHIAVNGRRSAESLYDFNLATYDEGDSFDQSAAKGFVYVHGLSSKIASRRDQR

SEQ ID NO: 3777 - protein, 164 aa, Mycobacterium paratuberculosis
MTRSKSTTETTRAARQARIVAILSSAQVRSQSELAALLADEGIEVTQATLSRDLEELGAVKLRGADGGVGVYMVPEDGSPVRGVSGGTARLSRLLSELLVSADASANLAVLRTPPGAADYLASAIDRAALPYVVGTIAGDDTVFVAARDPMTGAELADTLEKLT

SEQ ID NO: 3778 - protein, 309 aa, Mycobacterium paratuberculosis
MTPRHFLRDDDLSPAEQAEVLALAAELKKDPFSARPLEGPRGVAVLFDKNSTRTRFSFEVGIAQLGGHAVVVDARSTQLGRDETLEDTARVLSRYVEAIVWRTFEQQRLEAMAGAATVPVINALSDEFHPCQMLADLQAIAEHKGSLSGLRMCYLGDGANNMAHSLMLGGVTAGIHVTIAAPDGFTPAPEFVAAARRRAESTGATVTLTTDARAAARGVDVLVTDTWTSMGQEDDGLDRRTPFWPYQLNADLVSLADPEAIVLHCLPAHRGEEITDEVMDGPSSVVWDEAENRLHAQKALLTWLLERQS

SEQ ID NO: 3779 - protein, 409 aa, Mycobacterium paratuberculosis
MVTNTDALRRRWEAVMMHNYGTPPVALASGEGAVVTDVDGNTYLDLLGGIAVNVLGHRHPAIIEAVTKQLSTLGHTSNLYATEPSLALAEELVALLGAGHEPAGHESGGTESAGTARVFFCNSGTEANEVAFKLSRLTGRTKLVAAQEAFHGRTMGSLALTGQPSKQAPFAPLPGDVTHVPYGDAEALAAAVDDGTAAVFLEPIMGESGVVVPPEGYLAAARDITARHGALLVLDEVQTGMGCTGTFFAHQHDGITPDVVTLAKGLGGGLPIGACLAVGPAADLLTPGLHGSTFGGNPVCAAAALAVLRVLASENLVRHAEVLGKSLHQGIEGLGHPLVDHVRGRGLLCGVVLTAPHAKDAEAAAREAGFLVNAAAPGVIRLAPPLIVTEAQIDGFIAALPGILDRAAA

SEQ ID NO: 3780 - protein, 295 aa, Mycobacterium paratuberculosis
MTPSTEALPTAVKAQVLAEALPWLKQLHGKIVVIKYGGNAMTDDTLRRAFAADMAFLRNCGIHPVVVHGGGPQITAMLRRLGIPGDFKGGFRVTTPEVLDVARMVLFGQVGRELVNLINAHGPYAVGITGEDAQLFTAVRRSVTVDGVTTDIGLVGDVERVNAAAVLDLIAARRIPVVSTLAPDAEGVVHNINADTAAAALAEALGAEKLLMLTDVEGLYTSWPNRDSLVSEIDTATLSQLLPTLEAGMIPKVEACLRAVSAGVPSAHVIDGRVEHCVLVELFTDEGTGTKVVSS

SEQ ID NO: 3781 - protein, 404 aa, Mycobacterium paratuberculosis
VTETVNAARLLREQGVTAPAGFRAAGIAAGIKASGKRDLALVFNEGPDYGAAGVFTRNKVKAAPVLWSQQVLTTGALRAVILNSGGANACTGPGGFQDAHATAEAVAAALSDWGTETGAIEVAVCSTGLIGDRLPMDKLLAGVRTIVQDMAGGLSGGDDAAQAIMTTDTVPKQVALHHPGNWTVGGMAKGAGMIAPSLATMLCVLTTDAAVDPVALDTALRRATAATFDRLDIDGACSTNDTVLLLASGASGITPAQADLDDAVLRVCDDLCAQLQADAEGVTKRVNVTVTGAASDDDAVVAARTIARDSLVKTAVFGSDPNWGRVVAAVGIAPIALDPDRMTVSFNGSAVFADGVGTPGAREVDLSGPDIDITVDLRLGDGRATVRTTDLSHGYVEENSAYSS

SEQ ID NO: 3782 - protein, 347 aa, Mycobacterium paratuberculosis
MADVMRVAVAGASGYAGGEILRLLLGHPAYAQGRLAIGAVTAAASAGSPLGEHHPHLTPLAQRVLEPTDAAVLAGHDVVFLALPHGHSAALADQLGADTLIVDCGADFRLTDAAAWERFYGSPHAGSWPYGLPELPGARERLRGARRIAVPGCYPTAALLALLPAMAEDLIEPAVTVVAVSGTSGAGRAAKTDLLGSEVIGSARAYNIAGAHRHTPEIAQGLAAVSGRDVTVSFTPVLIPTSRGILATCTARTTAPFSALRAAYEKAYDAEPFIYLMPEGQLPRTGAVIGSNAAHIAVAVDEAAGVLVAIAAIDNLVKGTAGAAVQSMNLALGWPETQGLSVIGVAP

SEQ ID NO: 3783 - protein, 828 aa, Mycobacterium paratuberculosis
MRVPYSWLREVVAAGAPDWDVAPAELEQTLIRIGHEVEEVIELGPVDGPLTVGRVTDIEELTGFKKPIRFCHVDVGDDVDREIVCGATNFVAGDLVVVALPGTTLPGGFAIAARKTYGRNSDGMICSAAELGLGADHSGILVLPPGTAEPGADGAAVLGLDDVIFHLAITPDRGYCMSLRGLAREIACAYDLEFVDPADVKPLPVDGQAWPLTVQPDTGVRRFALRPVTGIDPAAVSPWWLQRRLLLSGIRATSPAVDVTNYVMLELGHPMHAHDRNRISGGLGVRFARPGETVVTLDDIERKLEPVDVLIVDDAATAAIGGVMGAASTEVRADSTDVLLEAAVWDPAAVSRTQRRLHLPSEAARRYERGVDPAISVAALDRCAALLAGIAGGKVSEALTDWRGEPACDGWSPPAIQMPADLPDRLAGVIYPPGTAAKRLAQIGAAVTADGGTLTVVPPSWRPDLLQPADLVEEVLRLEGLEVIGSVLPSAPAGRGLSAAQRRRRAIGRSLAQSGYVEILPTPFLPAGVFDVWGLPDDDPRRGTTQVLNPLEADRPHLATTLLPALLEALVRNVSRGLVDVSLYALAQVVQPTAETRAVQFIPVDRRPTDAEIAVLDASLPRQPQHVAAVLTGLREQRGPWGPGRRAEAADAFEAVRVIARAAGVDVRLRAAQQLPWHPGRCAEVLVGDTPVGYAGQLHPAVVERAGLPRGTCALELDLDAIPLVATLPAPRISPFPAVFQDVSLVVAADVPAQAVADAVCEGAGDLLEDLQLFDVFTGPQLGEHRKSLTFALRFRAPDRTLTEDDATAARDAAVRRAAEAVGAELRT

SEQ ID NO: 3784 - protein, 347 aa, Mycobacterium paratuberculosis
VGDQPVDLSETALAEAVGAARQAFARAGDLDALARLKTEHLGDRAPLALARQALGGVPKDQRADAGRRVNAARAQAQQAYDERLDVLRAERDAAVLVAERIDVTLPSTRQPVGARHPITILAEHIADTFIAMGWELAEGPEVEAEQFNFDALNFPADHPARSEQDTFYIAPEGSRQLLRTHTSPVQVRTLLARELPVYVISIGRTFRTDELDATHTPVFHQVEGLAVDRGLSMAHLRGTLDAFARAEFGPQARTRIRPHFFPFTEPSAEVDVWFVGKKGGAGWVEWGGCGMVHPNVLRAAGIDPDVYSGFAFGMGLERTLQFRNGIPDMRDMVEGDVRFLLPFGVGA

SEQ ID NO: 3785 - protein, 272 aa, Mycobacterium paratuberculosis
MIGGIVSRLARVQFTVGYAALLLAISCAILMLGPQAHDVIVQRASTNLHNLSHGHLGTLLGSALVVDAGPLYFWLPFLTCLLALAELHLRTIRLVVAFLVGHIGATLLVAAALAASVEFGWLPVSITRASDVGMSYGALAVLGAMTAVIPARWRAAWVGWWVAAGIASAIVGGDFTDAGHTVAVILGVLVSARFRQPIHWTPARYLMLAASSGFGFLMLAHHWGTMAATPVFGLLGAAVAYAAAKAYTGRGLAVTPLDGDDPLTGPQPAVAG

SEQ ID NO: 3786 - protein, 322 aa, Mycobacterium paratuberculosis
LRHMRRGRRCLASTKANNLARWNSRVAIWIRASPRNPRRRSRLRDAPHCRCTTPPSGCTTETTAPGRWHSSGVRAGCCRATPTSAIRCLPPAMAARAADRLLGDRDAVSREVSLGVLQVWQALTEGISRRPANPEVTLVFTDLVGFSTWSLQAGDDAALALLRQVARAVEPPLLDAGGHIVKRMGDGLMAVFGDPTVAVRAVLAAKEALRSVEVAGYTPRMRVGIHTGRPQRLASDWLGVDVNIAARVMERATKGGIMVSSSTLDHIPQSELDALGVEAKRTRKPVFGPKPAGMPADLAIYRLKTLKELSASDDTDETKPQP

SEQ ID NO: 3787 - protein, 355 aa, Mycobacterium paratuberculosis
MTGRSTTAADPLGPDSLTWKYFGDLRTGMMGVWIGAIQNMYPELGAGVQEHSILLREPLQRVARSVYPIMGVVYDGDRAPQTGRQITSYHHTIKGTDASGRRYHALNPDTFYWAHATFFMLIIKVAEYFCGGLTEAEKRQLFDEHVQWYRMYGMSMRPVPKSWEEFQEYWERTGREVLEINQATLDIFRMRIPKPKFVLIPTPLWDQLFRPLVAGQRWIAAGLFEPAVREKAGMHWTPGDEVLLRLFGKIVELAFLAVPDEIRLHPRALAAYRREQGRLPSDAPLVEAPPFMAPPRDRRGLPMHYFPPPPRLPFDPALQPARALMERAGSLVHTTLSLAGLRAGRGRPKRPVRAA

SEQ ID NO: 3788 - protein, 263 aa, Mycobacterium paratuberculosis
VLTERSGRVAAAAKLHRHVGRRRAARFLAEGSNLVEAAAGRGLVRDVFVTEAAQQRYAPLLAALDCPVHLVTERAAKALSDTVTPAGLVAVCDLPATGLRDVLAGSPRLIAVAVQISEPGNAGTLIRLADAMGAAGVLLAGHSVDPYNGKCLRASAGSIFSVPVAAAPDLREAVAAVREAGLQLLATTVDGEVRLDRAGELLAKPTAWLFGPESHGLPSAVAAAADHRVCIPMAGGAESLNVASAAAICLYQSARALELFTRP

SEQ ID NO: 3789 - protein, 131 aa, Mycobacterium paratuberculosis
MARVKRAVNAHKKRRSILKASKGYRGQRSRLYRKAKEQQLHSLNYAYRDRRARKGEFRKLWISRINAAARANDITYNRLIQGLKAAGVEVDRKNLADIAIADPAAFTALVDVARAALPEDVNAPSDSGEAA

SEQ ID NO: 3790 - protein, 64 aa, Mycobacterium paratuberculosis
MPKAKTHSGASKRFRRTGTGKIVRQKTNRRHLLEHKPTTRTRRLEGRTTVSANDTKRVNSLLNG

SEQ ID NO: 3791 - protein, 184 aa, Mycobacterium paratuberculosis
LIGPGGEQVGIVRIEDALRVAADADLDLVEVAPNARPPVCKIMDYGKFKYEAAQKARESRRNQQQTVVKEQKLRPKIDDHDYETKKGHVIRFLEAGSKVKVTIMFRGREQSRPELGYRLLQRLGADVAEYGFVETSAKQDGRNMTMVLAPHRGAKTRARARHPEGPGGAASDSDAAADAEPSSN

SEQ ID NO: 3792 - protein, 1177 aa, Mycobacterium paratuberculosis
LRRAGRSRQFSSVEEAFSTSAARPGPRGRRSGRENTAKFVPATLSASTSFSRIEGISSRSVTLASPGSRSGSGPRSGPRLGPRNRSTSRYRWVPAAAGWTVGVIATVSLLGSVSPLIRYLIKVPREFINDYLFNFPDTSIAWSFVLALLAAALTARKRIAWLLLLGNMILAAALNVADIAAGDNTAAEIFGENLGFAVHIVAIVLLVLAYREFWAKVRKGALVKAAAVLVAGDVVGILVSWGLVELFPGTLARQDRLPYVVNRVVGFALADPDLFTGRPHVFLNAIFGLFGALALIMATIVLFQSQRAENALTGEDESAIRGLLELYGKNDSLGYFATRRDKSVVFAQSGRAAITYRVEIGVCLASGDPIGDPRAWPQAVDAWLGLCQTYGWAPGVMGASTQGARTYREAGLNALELGDEAILRTSEFKLSGPDMRGVRQAVTRARRAGLTVRIRRHRDISPEAMADTIARADAWRDTQTERGFSMALGRLGDPADGDCLLVEAIDRDGSVVAMLSLVPWGTTGVSLDLMRRSPSSPNGTIELMVSELALNAESLGITRISLNFAMFRSAFEQGAQLGAGPVARLWRGLLLFFSRWWQLETLYRSNMKYQPDWVPRYACYEDARLIPRVGVASVIAEGFLVLPFSRRDKVHTGHHPAVPARLAQSGLLHHDGSAPDVSGLRPERTDAEEARSRLPEQVRVRLAKLKVLQRNGVDAYPVGCPPSHTVAQALDADDQQDITVAGRILRIRDFGGVLFAQLRDWSGEMQVLLDNSRLERGRTADFTAAIDLGDLVEVSGQMGFSKKGTRSLIVTDWRMIGKCLRPLPNKWKGLTDPEARVRTRYVDLAVNPESRELIAARSEVLRSVRQTLFAKGFIEVETPILQQIHGGATARPFVTHINTYDMDLFLRIAPELYLKRLCVGGVERVFELGRAFRNEGVDFSHNPEFTLLEAYQAHADYRVWIDGCRELIQNAAQAAHGEQTVLRPGADGRLQPVDISGIWAVKTVHDAVSEALGEQVDPGTSLSTLRKLSDAARIPYRAHWDAGAVVLELYEHLVEDRTEEPTFYVDFPTSVSPLTRPHRSRPGVAERWDLVAWGVELATAYSELTDPVEQRRRLQEQSLLAAGGDPEAMELDEDFLQAMEYAMPPTGGLGMGVDRLVMLITGRSIRETLPFPLAKPH

SEQ ID NO: 3793 - protein, 494 aa, Mycobacterium paratuberculosis
MTHVTDSPNGAPAQFLAFSHTSLMHGWVPMTVQVLAGVVLTLAVGWRSRRWRTVWVPVAALAGAAVAYLTHWYIVDRGLSDEPAPAALWLWVMLTGTAVAVLVLGWRTARRWRRGAAVLAVPLCSLSAALVLNLWVGYFPTVQSAWSQLTSGPLPDQTDQATVTAMAASRIRPPHGTVVPVAIPSDGSHFKHRGELVYLPPEWFATTPPPALPTVMMIGGQFNTPADWTRAGNAVKTIDDFAAAHHGQAPVLVFVDSGGAFNNDTECVNGVRGNAADHLTKDVVPFMISAFGVSPHRANWGVAGWSMGGTCAVDLTVMHPELFSAFVDVAGDFFPNAGNKAQTIARLFGGNADAWAAFDPTTVINRHGPYRDVAGWFAISSDGPPAPRRDIQLSDSGAIRLAAREAAANPGNQTAAAYSLCALGRANGIDCAVVPQPGRHDWPFADRAFAAALPWLAGALGTPGIPRTPLPATSSPAVGAPLVVPAERSNTGKR

SEQ ID NO: 3794 - protein, 219 aa, Mycobacterium paratuberculosis
VGPTRLFPYDPPPAQRSAKERIRDAALSCFAIRGVAATSLRTVAEAAEVSVGLVQHHFGTKLALVAAVDQYVLAQVGEALEATALTDAPVDGLDDAGQRLTSLMAERPDVMSYLGRALAEGGTLGAVIFDGLLAISAAQRDEFVRQGNTRPDLDPEWAALNPLILRVGAIILHPYIELRLRKSFFAEPELRRWDAAVTSLIRHGLFLDAPEARERGRGE

SEQ ID NO: 3795 - protein, 709 aa, Mycobacterium paratuberculosis
MHESAVSAYAAQLLDADNPDDMPELQRLQGDPNVEFIDRLDTQMANLANLRPAPPPELLAEPGRWAYYPWRRAVVAVLGPRGYRAVRLDRNRNNITSAEQDRLATLRVGVAGLSVGHVIAHTLAAQGLCGRLRLADFDHMELSNLNRVPATVFDLGVNKACVAARRVAELDPYLPVEVFAAGLTFDTVDAFLDGLDIVIEECDSLDMKAVLREGARARRIPVLMATSDRGLVDVERFDQEPQRPILHGLLGDLDIGLLPGMSSREKVPHILRHLEAERLSPRTAASLVEIDRTVSTWPQLASDVVLGAAALAEGVRRIGLGEELRSGRTRIDIGWALDRLDEPDMTRHGPTPVDDVHEAPELPGMAGTIASAAIRAPSGGNVQPWFVQAGPTSITIDVAAQHTSTMDVGFRGSSVAVGAALMNARIAAAAHQVLGPFSLSERVNGSPVRATLNLSDGTDPWLADLYQSMIRRETNRHHGSPRAVDAATIEALGDAANRECARLHLITGRDEIERAATLLAASDRIRYLTPHLHREMVSELRWPGDADPDTGIDVRSLELDAGDLALLDILRREDVMAYLARWNAGGALGEDTRDRILASSALAAITVRGRELRDYARGGAAVELVWIIAQRLGLAVQPVSPVFLYAHNRAEFDQLSPQFADELMQLERNFRALAEITKDEAAVLLLRFTAAPPASVPSRRSVERTRVRN

SEQ ID NO: 3796 - protein, 296 aa, Mycobacterium paratuberculosis
MSGTLDYLVTAAAAELMAATAADSAAISQRVLGNLVRDLGVDFSFLRHNDHTIRATILVAEWPPRNADPDPLGVVYFADADSVFAQAEHLKAPQVVRPEAANADYQRNIDEGTGWGTVSLAAVPLLSGDVTTGTLAFGKAGDREWLPEELNALQAIAALFAQLQARVVAEKQIHYLAEHDELTGLLNRRALIAYLTSASPRGNRARSRSCSWPSTGSRSSTVASGNTPATGSSRPSPRSSARPSTFRRSSLASAVTSSLSCPRRQWTSKRPRRSPGRCTACCTSRSRSTTKCLVAQ

SEQ ID NO: 3797 - protein, 435 aa, Mycobacterium paratuberculosis
THRAAEPQGAHRIPDKRLAPGQPGPVSVVFLAVDRFKVINGRLGQHAGDRFIEAFAALIRQTIDIPSVIARFGGDEFVVVPEAPMDVEAAEAFARSLHGLLHQQVEIDHEMLSRTVSIGVAAGAPGDETTSDLLRRVDQATRSAKSSGGNNVATFRPEMSTTDTIRNDIELHLEGMIDGASGALVLHYLPEFDMRTGAVLGTEALLRWQHPTLGLLMPDSFIQVVESINLGAKLGRLVMHSACAQFGLWQSRGVGKGAVLRINVSPVQLVTAGIVDTVAATLDEFRLDPSTICLEITESVVVQDIDATRQTLFGLKDIGVQIAIDDFGTGYSVLTYLKSLPVDSLKIDKGFVHSVDTNAGDLAIVRSTLALADAFGLGVVAEGVETVAAAQTLLSLGCHRAQGFLLSRPLDSAAMESLLAQRVVPMNFSETGPAV

SEQ ID NO: 3798 - protein, 199 aa, Mycobacterium paratuberculosis
MASRRARFRFFYRVGFTPWEGHPIGQGLRDLVEGAAGTQALPTGSALDLGCGTGDCAVYLAQHGWNVTGVDYVAKPLDKARAKAAAAGVAVDFVRADVTQLSQSGIGAAFDLIVDNGCIHNMSGGDRDAYVREVSAVAAPDARLFIVAFPPGGRFGVPGIDRAEIERRFTAGWTLLSTGQERALDDKTPTYYYLFQRRP

SEQ ID NO: 3799 - protein, 456 aa, Mycobacterium paratuberculosis
VSVAEPKRDIAGLPLAPKNPLSYRERLRAIKEFHTGTNKLRDAGGPVTRVTLGPRWLISPIVLATSPQGIRDIVSVRDGSIDKTSTVATELRRLLGPNLFVLPHTEWLPRRRTLQPVFTRQRVREFGGHMAEAAESVCAGWPEDTEIDLDAQCRTLTLRALGRSVLGLDLDERSDAIAEPLRVATSYAVRRALRPLRAPEWLPTPSRRRARAAAGAIRALADEILQACRADPGREAPLVHALIAATDPETGQALSDKEIRDEMIIFLFAGHDTTATTLTYALWALGRHPEYQARVAAEVAELPDRHLTPDDVARLGFTVRVLQEALRLCPPGPTGTRMATRDVEVAGYRVEAGTMLAFGRMAVQTDPSLWDAPLRFDPDRFDPRRAGDRDRWQYLPFGGGPRSCIGDHFAMLEATLALATIVRRVEIESLSDDFPLAVPFTMVAAAPIRAMVRRRR

SEQ ID NO: 3800 - protein, 243 aa, Mycobacterium paratuberculosis
VEVNMEAAQLAAREISDGPWPETGFGWYDQATGCRVTASTPEAEPELWNQYLDGALESYRKHGLDWVLDLERIRDGADTALFFAALDPQGRVVGGTRVVGPLRSPEDSHALQEWEGNPGLPLLRYMIANRIPFGVVEVKSAWTNSREYGNRALSTVLARTALPTMTLLGAQFVMATAAAHVLEQWQSSGGVVASRVPAAAYPNENYRTKVMWWDRRTLAAHADPAQFKLMCAENTEILSRLSA

SEQ ID NO: 3801 - protein, 78 aa, Mycobacterium paratuberculosis
MPDESATPADAGYDNAGVPTFDSVRDKIEARYATAQGAADLDAESPEGRSVAEQYDERERAAARRLAQIRESMRPQQD

SEQ ID NO: 3802 - protein, 971 aa, Mycobacterium paratuberculosis
VADRLIVKGAREHNLRGVDLDLPRDALIVFTGLSGSGKSSLAFDTIFAEGQRRYVESLSAYARQFLGQMDKPDVDFIEGLSPAVSIDQKSTNRNPRSTVGTITEVYDYLRLLYARAGTPHCPVCGERIARQTPQQIVDQVLAMPEGTRFLVLAPVVRTRKGEFADLFEKLNAQGYSRVRVDGVVHPLTDPPKLKKQEKHDIEVVVDRLTVKASAKQRLTDSVETALNLADGIVVLEFVDHEHDAHNREQRFSEKLACPNGHALAVDDLEPRSFSFNSPYGACPECSGLGIRKEVDPDLVVPDPERTLAEGAVAPWSTGHTAEYFTRMMAGLGDELGFDVDTPWRKLPAKARKAILEGSDHQVHVRYRNRYGRTRSYYADFEGVLAFLQRKMAQTESEQMKERYEGFMRDVPCPVCEGTRLKPEILAVTLAAGRHGKKSIAEVCELSISDCAEFLNTLTLGPREQAIAGQVLKEIQSRLGFLLDVGLEYLSLSRAAATLSGGEAQRIRLATQIGSGLVGVLYVLDEPSIGLHQRDNRRLIETLTRLRDLGNTLIVVEHDEDTIAHADWIVDIGPRAGEHGGQIVHSGTYAELLANQESITGAYLSGKESIEMPAIRRPVDRRRQLTVVGAREHNLRGIDVSFPLGVLTSVTGVSGSGKSTLVNDILATVLANRLNGARLVPGRHTRVTGLDHLDKLVRVDQSPIGRTPRSNPATYTGVFDKIRTLFAATTEAKVRGYQPGRFSFNVKGGRCEACTGDGTIKIEMNFLPDVYVPCEVCHGARYNRETLEVHYKGKTISEVLDMSIEEAAEFFEPITGIHRYLRTLVDVGLGYVRLGQPAPTLSGGEAQRVKLAAELQKRSTGRTIYILDEPTTGLHFDDIRKLLKVINGLVDKGNTVIVIEHNLDVIKTSDWIVDMGPEGGAEGGTVVAQGTPEDVAAVPESYTGKFLAEVIGRGGAAAGAPRRSSRRRKATA

SEQ ID NO: 3803 - protein, 259 aa, Mycobacterium paratuberculosis
MNPLRTAGIRTAHSMLGAHTDKQRLTSNVAAMTASVVPSDNYTGHVDPGTAARRTLPGATIIKASVGPMDNNAYLVTCSATGETLLVDAANDADVLIGLIRDYAPKLSLIVTSHQHFDHWQALADVAAATGAPTAANEIDADPLPVKPDRLLAGGDTVRIGELAFDVIHLRGHTPGSIALALDGEATGGVTQLFTGDCLFPGGVGKTWLPGDFDQLIDDVTTRVFDVYDDSTVVYPGHGDDTVLGNERPHLSEWRERGW

SEQ ID NO: 3804 - protein, 147 aa, Mycobacterium paratuberculosis
MGAYRTVVVGTDGSDSSMRAVERAAQIAGPDAKLIVASAYLPQHEDARAADALREESYKVSGTAPIYAILRDAKERAHQAGAKNVDERPIVGVPVDALVHLAEEEQADLLVVGNVGLSTIAGRLLGSVPANVSRRAKTDVLIVHTTS

SEQ ID NO: 3805 - protein, 616 aa, Mycobacterium paratuberculosis
LVSQPKTVSRLLDAEEVDQRHGVARRVCQFGGPGCGNGQFRRCQNNPIPEGSAESIALRRFSPIAGPTANSPAAVCEPPHRARPKVTSIMSMPTLEPTFESGAGDIVAEPAPRRPRGRLLDPWAIAVLATALSAAWACRPSLWFDEGATISAAANRTLPELWRLLGHIDAVHGAYYLLMHGWFALFPPTEFFSRFPSALAVGAAAAGVTVFTRQFAPRRTAVCAGAVFALLPRMTWAGMEARPYAFVAAAAVWLTVLFVAAVRRGAPRRWVGYALALMLAILLNLNMVLMVPVYGVMLPLLTARGARRSAALWWAGSSAVAVGAMTPFLLFAHNQVWQVNWIYPVSWHYAFDIILRQYFDHSVALAVLSAVLIVAAAVARLAGVPAPPGDLRRLLILCAAWMVIPTALVVVYSAVGEPIYYPRYLIFTAPAMAIVLAVCIVTLARRPWPIAGAVLLCAVAALPNYLFVQRWPYAKEGWDYSQVADLIGSHAAPGDCLLVDNTVPWRPGPIRALLATRPAAFRSLIDVERGAYGPKVGTLWDGHVAIWLTTAKINKCSTIWTITNKDNSLPDHQSGQSLPPGSAFGQAPAYRFPGYLGFHIVERWQFHYSQVVKSTR

SEQ ID NO: 3806 - protein, 240 aa, Mycobacterium paratuberculosis
MQIWLTGAPLLGGSVQGARHAVELFAAFGLTALIGLERTIQGKSAGLRTQTIVGTSSALIMLVSKYGFSDVLSAGSIVLDPSRVAAQVVSGIGFLGAGIIITRRGAVHGLTTAAAVWESAAIGLATGAGLLLLAIAVVGLHFVSALAFNAVERQLNARLRGTVRLRIIYANGRGVLRELLRLSGQRDWQLTELDADPHDIDDGEVAVSMTLSGAKIADAAHVFAEVDGVAAVLSADDATD

SEQ ID NO: 3807 - protein, 356 aa, Mycobacterium paratuberculosis
MQGVAGGLLAGLGYAVINSALPRWLWTRGSALVSAMWGVATVVGPATGGLFAQLGIWRWAFVVMAVLTALMALLVPVALARVDPAPAIPRMKVPVWSLLIIGVAALAVSVAQIPHNTAATFGLLAAGIMLVGLFVIVDWRMHAAILPPSVFSPGPLKWIYLTMGVLMAAAMVNTYVPLFGQRLAHLTPIAAGFLGAALALGWTVSEIVSASLENPRTVGRVVMVAPLVAASGLALGAVARHGDGSAWTAALWAVALLVAGTGIGMAWPHLSARAMASVNDPAEGGAASAAINTVQLTSAAIGAGLAGVVVNTATGGDEMAAHLLFTVFTALSAAGVAVSYAATRATRQAQPVGNVG

SEQ ID NO: 3808 - protein, 722 aa, Mycobacterium paratuberculosis
MAFATEHPVVAHSEYRPAEEAVEGLVRAGGRFEVVSPHAPAGDQPAAIDELERRIRAGERDVVLLGATGTGKSATTAWLIERLQRPTLVMAPNKTLAAQLANELREMLPHNAVEYFVSYYDYYQPEAYIAQTDTYIEKDSSINDDVERLRHSATSSLLSRRDVVVVASVSCIYGLGTPQSYLDRSVELRVGTEVPRDALLRLLVDVQYTRNDLSFTRGSFRVRGDTVEIIPSYEELAVRIEFFGDEIEALYYLHPLTGDVIRQVDSLRIFPATHYVAGPERMAHAISTIEQELAERLAELEGQGKLLEAQRLRMRTNYDIEMMRQVGFCSGIENYSRHIDGRGPGSPPATLLDYFPEDFLLVIDESHVTVPQIGGMYEGDMSRKRNLVEYGFRLPSACDNRPLTWEEFADRIGQTVYLSATPGPYELSQTGGEFVEQVIRPTGLVDPKVVVKPTKGQIDDLIGEIRKRTEADERVLVTTLTKKMAEDLTDYLLEMGIRVRYLHSEVDTLRRVELLRQLRLGEYDVLVGINLLREGLDLPEVSLVAILDADKEGFLRSARSLIQTIGRAARNVSGEVHMYADTITESMKEAIDETERRRAKQIAYNEAHGIDPQPLRKKIADILDQVYREADDTDTVEIGSGRSMSRGRRAQGEPGRAVSAGIVEGRDTTNMPRAELADLIKDLTAQMMAAARDLQFELAARFRDEIADLKKELRGMDAAGLK

SEQ ID NO: 3809 - protein, 115 aa, Mycobacterium paratuberculosis
MYLVYTSPPSDITWGLARDTRESIIDQGPWPDADEAATYYFLLDLEEGCATSNYPREPGEILWCGYPLEDDLPARPSDIPDTYRITPSQRTSSAKRPRDENRPVVNEPRLYADPP

SEQ ID NO: 3810 - protein, 261 aa, Mycobacterium paratuberculosis
MAAVAGFPDLSQVLAWPTQHLTDAARHWEAVGERSYSVIHQVWRDGLSSDWRGRAADALHAATHDDVGKTSGVADQLRAAAGVARSGACELVAARSRVRYAVEDAMRSGFDVYEDMSVADRSTGGSAAQRAARQAQAQAFAGDIRRRAAELVALDQQVAGRVTAATAGIRDTFPQTPDSDAPQRKPKFHAVDHHTFKEDPPPNGSYPVNEVVAEATDLDGNHVVLRRGYYNAEKKRGMGLGQGVLEAWRGQPQCLQRPDLT

SEQ ID NO: 3811 - protein, 620 aa, Mycobacterium paratuberculosis
LTIGNGASFAGYTILRQLGAGGMAEVYLALHPRLPRRDVIKVLAEAVTVDPEFRERFNREADLAATLWHPHIVGVHDRGEFNGHLWISMDYVEGTDASRLVKESYPDGMPLDEVSAIVQAVAGALDYAHARGLLHRDVKPANILLTHPEAGERRILLADFGVARHLGDISGITETNVAVGTVAYAAPEQLTGSPIDGRADQYALAATAFHLLTGAPPFQHSNPIAVIGQHLHEDPPRLSDFRPELAGLDEVFCQALAKAPEDRFDRCRAFAAAVRRECDGAAAIGPDARSRSVASPPHRRRGPGRVIAAVTHRFSSQTRWAAALVCAVLVAVAATWSVLYSFQPGAPPANPALASKPSPPAAVAAPIAGGPVLNGTYKLDYDQTKRTTNGIGIRHDGAGTNWWAFRSACTSSGCAATGTRLDDATHQTAGGPDGGQTDTLRFVGGYWQGAPEQQRVGCTRPGGPAGATQQETIAWSLAPQSDGTLRGTETETVLSNECGAQGAVVRVPVVATRVGDVPPGVTVADPASVINASPTATAPAPPVLGGLCSDVGKVAYDPTNNEQIVCEGSSWAKAPITMGVHAAGSSCDRPGTSVFAMSTSSDGYLLQCDPVTRTWTRPAG

SEQ ID NO: 3812 - protein, 866 aa, Mycobacterium paratuberculosis
VVTRPAPPILTIRHDGSQRSFAAGHEVVVGRHVQADVRIPDPRISRAHLILRFEQGRWLAIDNGSLNGTYLNGYRMPVVDIHDGQSIHVGNPHGPRLTFALGPQQGHAGHPGRPRPSHDSGPPTLTWTAITEQTNPTRPTRRPVPPRRPARPPSTPPEERTVIVPGSPARSRVAPASAPAGPPRTSPTPATEFTVIDAKTADVSNLATRFVKLLSPRASSAAGTAGAMTIGRAADNDIVVADVLASRHHATLVPTALGTEIRDNSVNGTFVNGTRVGSAILSDDDVVTIGNVDLVFRDGTLTERGQTATRSGGLEVRNVTYVVDDGKQLLDDISLTARPGTLTAVIGGSGAGKSTLARLIAGYTTPSSGSVTFEGHNIHAEYASLRSRIGMVPQDDVVHRQLTVNQALGYAAELRLPPDTGKADRARVVAQVLEELDLTKHADTRVDKLSGGQRKRASVALELLTGPSLLILDEPTSGLDPALDLQVMTMLRQLADAGRVVLVVTHSLSYLDVCDQVLLMAPGGKTAYCGAPDRIGPAMGTTNWAKIFTQVGADPEEANRRFREQREAQQRPHKSDRADEPEDLGEPVHTSLRHQISTIARRQVRLVVADRAYFVFLALLPFILGSLSLTVPGHNGFRGPAPAAGTPDEAAQILALLLPAAAFMGTALTIRDLVGERAIFQREQAVGLSTTAYLLAKTAVFCGFTVLQSAIVTAIVVIGKGAPTRGAVLFGHSTAGAVAELFATVAATCVASAVLGLAISSLVRSSEQIMPLFVVTVMAQLVLCGGMVPVTGRLGLNQLSWAMPARWGYAAASATVDLRHLVPDSLLSQDRFWLHTPGTWLLDMGMLAALALCYAVFVRWKIRLRR

SEQ ID NO: 3813 - protein, 154 aa, Mycobacterium paratuberculosis
VRTVDEYAVRPWGLYLARPTPGRVQFHYLESWLLPSLGLRATVFHFNPGHERDHDYYLDVGDYLPGPTVWRSEDHYLDIEVRTGIRAELTDVDELLDALRHGLLTPEVAERAIQRAVAAVDGLARNGYDLTRWLSEIDMELTWRGRAAAPEPAP

SEQ ID NO: 3814 - protein, 354 aa, Mycobacterium paratuberculosis
VAERDRHGTDLAGTRRGAGAGAVTDFAALPDSVRAALRDEPVPQWCSPTLATLTEKRFSDPHWIFERKFDGMRCLAFRDGDRVRLLSRNRKPLNGTYPELVESLAAQRETRFVLDGEVVAFEGRRTSFARLQGRLGITDPDVARASSVRIYYYVFDLLHLDGKSTVAVPLIWRKRLLRKAIDFTDPLRYAPHRVGDGMAAYRAACGRGDEGVIAKRAESAYDGRRSENWLKFKCVRDQEFVVGGYTSPKGKRLELGALLLGYYQGDQLRYAGKVGTGFDEATLHRLHQLLSGIACDTTPFTRSLVPEAGAHWVRPELVVQIGFTEWTRDGKLRHPRYLGIRTDKDPTEVIRETR

SEQ ID NO: 3815 - protein, 262 aa, Mycobacterium paratuberculosis
MPELPDVEGFRRQLADALPGRRVRRVKVHDPGILRNTTATTLARRLTGRRFAGPRRHGKWLVLPTDGPTLLIHSGMTGRPYYCADGAAEDRHQRLVVSLDQGELRYTDLRKLRGVWLADDPDDLVPITGRQGPDALGLGLRDFRDALTARSARRRQLKSALMDQSVLAGLGNLLVDEICWRARIRPTRAVADLDDDEVKALHRAMTQVLRTAVRHGRVPGLPRWLTGARDAPDPHCPRCGGRLDHARVGGRTTLWCPRCQPG

SEQ ID NO: 3816 - protein, 137 aa, Mycobacterium paratuberculosis
MSASNHRLMPIAALIIIAAGSQLSPAPARADLHNITYRARIDAVTTGSQATFVTNGGQTNTAALSSMPGNAFEADTVLPDPQQAGMRIVLHFPYAANVHCEIDVDDDVFVQTDQMVRPAPGNTDPMNGALQCGAPLP

SEQ ID NO: 3817 - protein, 407 aa, Mycobacterium paratuberculosis
MLRIGLTGGIGAGKSALSSAFAQCGAVIVDGDVIAREVVRPGTEGLAALVEAFGRDILLADGSLDRPALAAKAFADDAARQTLNGIVHPLVGARRAEIIASVPADSVVVEDIPLLVESGMAPLFPLVVIVYADVEVRLRRLVEQRGMAEADARARIAAQASDEQRRAVADIWLDNSGSPAELVQRAQQVWNERIVPFAHNLSTRQIARAPVRLVPPDPEWPAQAQRIVNRLKTASGHRALRVDHVGSTALPGDPDFAAKDVIDIQITVESLAAADELVEPLLAAGYPRLEHITADVAKPDARSTVERYDHTGDPALWHKRIHASADPGRPTNVHIRVDGWPGQQFALLFVDWLTADPDARADYLAVKRSAEQRADGDIDAYVAVKEPWFRDAYRRAWDWADSTGWKP

SEQ ID NO: 3818 - protein, 480 aa, Mycobacterium paratuberculosis
MPSPAVTSPQVAVNDIGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGTVIEVVKGGLILDIGLRGFLPASLVEMRRVRDLQPYIGKEIEAKIIELDKNRNNVVLSRRAWLEQTQSEVRSEFLNQLQKGAIRKGVVSSIVNFGAFVDLGGVDGLVHVSELSWKHIDHPSEVVQVGDEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKQANEDYTEEFDPAKYGMADSYDEQGNYIFPEGFDPETNEWLEGFEKQRAEWEARYAEAERRHKMHTAQMEKFAAAEAAGHAGGEQSPGNGAPAEKAGGSLASDAQLAALREKLAGNA

SEQ ID NO: 3819 - protein, 508 aa, Mycobacterium paratuberculosis
MVLADVQAPSRYWENIAGETDLDVTDITGTLPDGLVGTLYRNGSGRWTVGSTQVESIFDADGMVSAFVLDGSGVRFRNRFVRTRHYLRSTAAGRLVDRGFAYQRPGGPRANALRLPANTANTSVMVHRNQLLALWEGGPPHELDLDTLDTIGPCNLGGALRGPVRAYSAHYRYDPMTNTKVNFGFDPYVPRIDPGHALRGPRRLRRLRELAAEAVPRVRLRLYETGADGVTRYLRAVPLPGMGVVHDMALTTRYAVFVLSPLRINPWALTGRQSYWESIRFKPDAPSYFVLAPRDGGAVRVVETDPFYHWHFTNAYDDGDDVVVELPRFAPQTYAGMKNYTAHIRSDIAQVDDYGAIEDAVVLTRFRIAASGRVTREPLADFGCEFPQIDPRRGTMRHHVSYLTVQDPAKFPGQGIARVDHRTGEAQTYCPPGQVLVEPIFVPRPGGTAEDDGWLLTVGYDESRHRSRLMVVDAAHVADGPVAEAWLPFHVPMSYHGTFTTRVAQRTG

SEQ ID NO: 3820 - protein, 209 aa, Mycobacterium paratuberculosis
MPAARRRRGRPAGSRVDPDERRTALLDAAERAIRAKGPSAGLVDIAGEAGFVRSAVYAMYPGRDALLAELSRRTAQRLLGEITTRAAGSTDLRQRMALFFDVISAWMQAEPNLYRALTGDPSTSVFEQLAGAVEQMLTTSSGSEQARRAAAPWSRAIVGSAVSAAEWWCRAGTMPRAELVEHLTALCWDGGAALPFDADDIRTIDSGPH

SEQ ID NO: 3821 - protein, 919 aa, Mycobacterium paratuberculosis
VPKVRAVPATKAATKTATKTAAGAGEEQNRPTLMLLDGNSLAFRAFYALPAENFKTRGGLTTNAVYGFTAMLINLLRDEAPTHIAAAFDVSRQTFRSDRYPEYKANRSATPDEFHGQIDITKEVLAALGITVLAEPGFEADDLIATLATQAENEGYRVLVVTGDRDSLQLVSDNVTVLYPRKGVSELTRFTPEAVVEKYGLTPQQYPDFAALRGDPSDNLPGIPGVGEKTASKWIAEYGSLQALVDNVDSVRGKVGDALREHLASVIRNRELTDLIKDVPLAQTPDTLRLQPWDRDQIHRLFDDLEFRMLRDRLFETLAAVEPEVDEGFDVRGGALEAGELAVWLAEHSSGKRFGLAVAGTHLAYDADCTALAIVSADGEGRYIDTSALDPDDEAALASWLADPGPPKALHEAKLAMHDLAGRGWTLAGVTSDTALAAYLVRPGQRSFSLDDLALRYLRRELRAENPQQQQLSLLDDTDGTDDQAVQTLILRAVAVLDLADALDEELARINSTSLLSGMELPVQRVLAGMENAGIAVDLDLLSELQSDFAHQIRDAAEAAYAVIGKQINLGSPKQLQAVLFDELQMPKTKRTKTGYTTDADALQSLFDKTGHPFLQHLLAHRDATRLKVTVDGLLNSVASDGRIHTTFNQTIAATGRLSSTEPNLQNIPIRTEAGRRIRDAFVVGDGYAELMTADYSQIEMRIMAHLSQDAGLIEAFNTGEDLHSFVASRAFGVPIEEVTGELRRRVKAMSYGLAYGLSAYGLSQQLKISTEEAKEQMDAYFARFGGVRDYLHAVVEQARKDGYTSTVLGRRRYLPELDSSNRQVREAAERAALNAPIQGSAADIIKVAMIEVDKAIKEAGLRSRILLQVHDELLFEVAAGEREQLEALARDKMGGAYPLDVPLEVSVGYGRSWDAAAH

SEQ ID NO: 3822 - protein, 146 aa, Mycobacterium paratuberculosis
VPEVIRQQPAVEGWFATDEAGAPHLIGSKCPQCGTYVFPPRENNCPNPGCDGDALESTPLSRRGTLWSYTENRYAPPPPYPSPDPFEPFAVAAVELAKEGLIVLGKVVEGTLAADLKVGMEMELTTMPLYTDDDGVQRMVHAWRRA

SEQ ID NO: 3823 - protein, 404 aa, Mycobacterium paratuberculosis
MTTPSTPPEPLYILGAGMHPWGKWGNDFTEYGVAAARAALAEAGLDWRQIQLVAGADTIRNGYPGFVAGATFAQKLGWNGVPVSSSYAACASGSQALQSARAQILAGFCDVALVIGADTTPKGFFAPVGGERKNDPDWQRFHLIGATNPVYFALLARRRMDLYGATLEDFAQVKVKNSRHGLQNPNARYRKEVSVEDVLASAVVADPLRLLDICATSDGAAALVVASAKFAREHLGSLAGVPSVRAVSTVTPRYPQHLPELPDIATDSTAAVPAPDRVFKDQIIDAAYAEAGVAPEDLSLAEVYDLSTALELDWYEHLGLCPKGEAEALLRSGATTLGGRVPVNPSGGLACFGEAIPAQAIAQVCELTWQLRGQATGRQVENATVGITANQGLFGHGSSVIVAR

SEQ ID NO: 3824 - protein, 207 aa, Mycobacterium paratuberculosis
MSVMTGPTTDTDAAVPRRVLIAEDEALIRLDLAEMLREEGYEIVGEAGDGQEAVELAERHRPDLVIMDVKMPRRDGIDATSEIASKRIAPIVVLTAFSQRDLVERARDAGAMAYLVKPFTISDLIPAIELAVSRFSEIAELEREVATLSERLETRKLVERAKGLLQTEQGMTEPEAFKWIQRAAMDRRTTMKRVAEVVLETLGTPKE

SEQ ID NO: 3825 - protein, 443 aa, Mycobacterium paratuberculosis
VAAKSCGAAPLWPNGSSKRPDCVAAARAQSRARNQHYADSAARQSRVLAIAAWLAVLVCADFILLQVVTGAWTWQIVSLNVVAALIFAIVPWLHRFGDLVAPLTFLGAAYVTVFVSCWDVGTASGGQYFFLVGACLVLLVMGIEHTVLAAVLAAIGAGLVIAVEFAFPRDTGLQPAWAQSMSFVVTIVSACIMVFVAVWFALRDTQRAEAVMESEYQRSEALLANMLPGSIAERLKHSDGDIIADKYDDASVLFADIVGFTERASGTAPADLVRFLNRLYIAFDDLVDKHGLEKIKVSGDSYMVVSGVPRVRPDHAAALADFALDMVKVAAALKDPYGRPVPLRVGMACGPVVAGVVGSRRFFYDVWGDAVNVASRMESTDSVGRIQVPETMYERLAPEFVLQERGRIEVKGKGVMRTWYLIGRKPAEAPTDLVAEQPHTAHV

SEQ ID NO: 3826 - protein, 197 aa, Mycobacterium paratuberculosis
LCQTAAMTMSPGSPVPSLLPHLWKSALLSGILSLALGVLVLVWPGISILVAAVAFGVYLLITGIAQVVFAFSLHVSAGSRVLLFISGAASLILALLAFRHFGQGYAILLLAIWIGIGFIFRGVATTISAVSDPNLPGRGWNIFLGVISLLAGIVVLASPFESIVTLAIVVGAWFVVIGVFEIISSFGIRKASKTLAG

SEQ ID NO: 3827 - protein, 490 aa, Mycobacterium paratuberculosis
MNVVDISRWQFGIVTVYHFIFVPLTIGLAPLLAIMQTAWVATGNTAWYRLTKFFGKLFLINFAIGVATGIVQEFQFGMNWSEYSRFVGDIFGAPLAMEGLFAFFFESTFIGLWIFGWGRLPKLIHLACIWIVAIGVNASAFFIIAANSFMQHPVGAHYNPATRRAELDDIFALLSNNTAQAAFPHTVTGALLTAGTFVAAVSAWWMVRSRAGGSTTPAAETEARTMFRPAAILGCGVVLLATVALFFTGDRQGKLMFVQQPMKMASAESLCHTQTDPDFSVLTIGTHNNCDSVTEVIKVHYVLPWLAEGRFSGVTLRGVNELQQQYQQRFGPDDYRPNLFVTYWSFRLMIGFLAIPVLFALTVLWVTRRGRTPRQRWMSWFALLTIPTPFLANIAGWVFTEMGRQPWVVVPNPTGDQAVRMTVREGVSNHVPGMVITSLVTFTLVYAVLAVVWFFLLKRYTVEGPLEHDAEPAPPRAPSDDEVAPLSFAY

SEQ ID NO: 3828 - protein, 346 aa, Mycobacterium paratuberculosis
MGLQEVWFGIIGMLFLGFFILEGFDFGVGMLMEPFARVGIGEPEPLRRTALNTIGPVWDGNEVWLIVGGAAMFAAFPGWYATVFSTLYLPLLAILFGMILRAVAIEWRGKIDDTKWRGWADFGIAAGSWLPAVLWGVAFAVLVRGLPVDADGHIHLSVTDVLNPYTLLGGLATAGLFLLYGAVFVALKTSGAIRDDAYRFAVWLSLPVTGLVAGFGLWTQLGYGKNWTWLVLAVAVVAQVAAVLLVWRRASDGWAFTCLALVVAAVVILLFGALYPNLVPSTLDSRWSLTIYNASSTHYTLKVMTWVTAIMAPVTVVYQAWTYWVFRQRLSADRIPAPVGLTRRPS

SEQ ID NO: 3829 - protein, 532 aa, Mycobacterium paratuberculosis
VGCGVLISGCAIGSAVVLAGIVARVVGDTSAGEMRSWPAPLSILLALWAIRAVAHWLQARLGQRGASAVIADLSGQVLAAVIARPPAELAAQRDEAAVVVTRGLDGLRPYFTGYLPTLMLAAILTPATVAVIAAYDVKSTVIVAITLPLIPIFMVLIGLATRDRSAAALAAMTTLQARLLDLIAGIPTLRALGRSSGPDRRIAELAAAHRRSAMATLRIAFLSALVLELLATLGVALIAVGIGLRLVFGEMTLTAGLTVLLLAPDVYWPLRRIGVEFHAAQDGRTAAGAAFALIGEPSGPSAAKVRTRTVTARGAPIRLEHLSVAGRDGQAPCDLSAVMEPGAVTVLTGRNGAGKSTTLQAIAGITAPSSGRVTVRGVDVADLEPRGWWAQLSWLPQRPVLVPGTVDDNLRLFGELDDIETACAIAGFDTVLAELPDAGATPLGRGGVGLSLGQRQRLGLARALGSRAAVLLLDEPTAHLDAGTEERVLRAVVERARAGATVVVVGHREPVLAIGDRVVAVSADRGARCAAA

SEQ ID NO: 3830 - protein, 565 aa, Mycobacterium paratuberculosis
VEHVVPRPDSFASASSRRPLLAAAGLLSPRLPRLAAAITLGVLSLGSALALAGVSAWLITRAWQMPPVLDLSVAAVAVRMFAISRGVLHYCERLVTHDTALRAAGAARVAVYQRLTRGGAAATVRLHSGELVARVGADVDELANVLVRALVPMGVAAVLAVAATAVVAAISPAAGGVLAICLLVAGFVAPRLAGRAAATQEDIARQQHSQRDSAAMLALEHAPELRIAGLLPDVIAESQRRQRAWGAALDAAGKPAAVAEAMPTAAIGASVLGAVVAAIGMAHAVAPTTLAVLMLLPLSAFEAMTPLPAAAVQLTRSRIAARRLLELTATEPPRPAGSAPRPTGPGRLTADIHSGHDGAARESRVTLDLPPGARLTVTGASGCGKTTLLMTLAGLLPPLQGQVVLDGVALSEFDECELARAIVFFAEDAHVFATTVRDNLLVARGDCPDDELTDALEAVGLGDWLAGLPDGLSTVLTGGAQAISAGQRRRLLLARAVISPARIVLLDEPTEHLDAGDAERLLRDLLAPDSRLLPSPRTVVVATHHLPEGIGCRELHVDRGPADAG

SEQ ID NO: 3831 - protein, 483 aa, Mycobacterium paratuberculosis
VQRRRTAARLLSAHREVRVNGPVVDVATKPRAGERVVVSADSRAARLIGALALFCAACWLIQILVHHHSNPSWHYADRLAWSLTVLVAVAWIARGIFLGRPVTTMHAAVAAFFVLAGLGLHVLSFDLLGDVLIAGSGMVLMWPTSSHPRPADLPRIWELINATRDDALAPFTMQTGKSYHFSADGSAALAYRTRLGIAVVSGDPIGDEAHFPELVADFAVTCHAHGWRIAVVGCSERRLELWKDSAVLGQTLRPIPIGRDVVVDVSSFDMVGRKFRNLRQAVKRTHNCGVTTEIVAEQELSDELLAELTEVVRESSKGAHADRGFHMNLDGVLEGRFPGILLIIARDATGKVQAFHRYATAGGGSDITLDVPWRRRGAPNGLDERLSVDMVMAGKDRGAQRVSLAFAAFPEIFEDKNRGWTRRIFYRLTHVLDPLIALESLYRYVRKWHALDGRRYAVISMTQIVPLLFVLLSLEFLPRRRHL

SEQ ID NO: 3832 - protein, 300 aa, Mycobacterium paratuberculosis
VPAGAESQEPNTTADFEELLATLDLRRVADDLFVGSHPSKSPMRTFGGQLMSQSFVASSRSLIRDDLPPSALSVHFINGGDTGKDIEYRVTRLRDERRFANRRVDAVQDGTLLSSALISYMAGGRGLEHGVDPPRVADPETQPTIGELLRGYEETVPHFVNALQPIEWRYTNDPAWVMRTKGERLPHNRVWVKALGKLPDDPVLHTATMVYSSDTTVLDSVITTHGLSWGFDRIFAASANHSIWFHRQVDFNDWVLYSTSSPVAADSRGLGTGHFFDRSGQPLATVVQEGVLKYFPSARR

SEQ ID NO: 3833 - protein, 472 aa, Mycobacterium paratuberculosis
VSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 3834 - protein, 139 aa, Mycobacterium paratuberculosis
VMPSQPLARGGRHRRHVAAGTAVVLSGALGYIGLADPHDPASIYPPCPFKWLTGWNCPFCGGLRMTHDLLHGELWAAVHDNVFLLAAVPTLAAFLLVRRARGRRSLPAAAVPAVVVATLVWTVLRNLPAFPLFPTVLGG

SEQ ID NO: 3835 - protein, 427 aa, Mycobacterium paratuberculosis
VTKLLAYFPSPPQGVWHLGPVPIRAYALFIIAGIVAALLIGDRRWEARGGERGVIYDIALWTVPFGLVGGRLYHLATDWRTYWGPGGAGFGAAVRIWDGGLGIWGAVALGAVGAWIGCRRHGIPLPAFADALAPGIILAQAIGRLGNYFNQELYGRETTLPWGLEIFYRRDPSGYIDPHSLDGVSTGQVALVVQPTFLYELLWNLLIFVALLYADRRLTLGHGRLFALYVAGYCVGRFCVELLRDDTATHIAGIRINSFTSTFVFIGAVVYLMAAPKGREDPESLRGNQYVEEEPAEPEPATVAATTEAATEGVAAPADGAEAAGADATAQRPEESAEPDVEKPESEETEAAEEASEPEAEEPEAPEAEEPEEPETEEPEADSGEEPEEESGEAPEQLVAEEPEPAPQQPETKRRWGARLRERLSGR

SEQ ID NO: 3836 - protein, 271 aa, Mycobacterium paratuberculosis
MTVKQSQASRLSPIFEPCRDDDRAALIGYLPTGYPDVPTSVQAMVALVESGCDIVEVGVPYSDPGMDGPTIARATEAALHGGVRVRDTLAAVEAISAAGGRAVVMTYWNPVLRYGVDAFARDLAAAGGYGLITPDLIPDEAGQWLAASERHGLDRIFLVAPSSTPQRLALTVEASRGFVYAASTMGVTGARDAVSHAAPELVSRVREISDIPVGVGLGVRSREQAAQIGGYADGVIVGSALVSALGDGGLTALRALTEELAAGVRQRAAAS

SEQ ID NO: 3837 - protein, 421 aa, Mycobacterium paratuberculosis
VDISPRTRPDLPLPSAAIAEPTRHEPDAGGHFGVYGGRYVAEALMAVIEEVTTAYEKERVNQDFLDTLDYLQANYAGRPSPLYEAPRLSEQAGARIFLKREDLNHTGSHKINNVLGQALLAQRMGKKRVIAETGAGQHGVATATACALLGLECVIYMGAVDTERQALNVARMRLLGATVVSVQSGSKTLKDAINEAFRDWVTNADNTFYCFGTAAGPHPFPAMVRDFQRIVGLEARAQIQAQAGRLPDAVVACIGGGSNAIGIFHPFIDDPGVRLVGFEAAGDGVETGRHAATFSGGSPGAFQGSFSYLLQDEDGQTIESHSISAGLDYPGVGPEHAYLRETGRAEYRPITDAEAMEAFRVLCRTEGIIPAIESAHAVAGALKLGPELGRGAIIVVNLSGRGDKDVETAAKWFGLLGSSDR

SEQ ID NO: 3838 - protein, 272 aa, Mycobacterium paratuberculosis
MSPATVLDSILEGVRADVAAREALISLSEIKAAAAAAPPPLDVMAALREPGIGVIAEVKRASPSAGSLATIADPAKLARAYEDGGARIISVLTEERRFHGSLDDLDAVRAAVSIPVLRKDFVVQPYQIHEARAHGADMLLLIVAALEQSALVSMLDRTESLGMTALVEVHTEEEADRALRAGAKVIGVNARDLATLEVDRDCFARIAPGLPSNVIRIAESGVRGTGDLLAYAGAGADAVLVGEGLVKSGDPRAAVADLVTAGTHPSCPKPAR

SEQ ID NO: 3839 - protein, 143 aa, Mycobacterium paratuberculosis
MTEARARRLDGRWLIRIAQLLLVIAAVGLWVAARLPWVVIRSFDGLGPPKAVTLSGGTWSTALLPLALLLLAAAVAAIAVRGWLLRALAGLLAVASLAVGYLGVSLWVLSDVAVRGTELAHLSVISLVGSERRYLGAGKCRSG

SEQ ID NO: 3840 - protein, 510 aa, Mycobacterium paratuberculosis
VHAHLAATTSREDFRQLAAEHRVVPVTRKVLADSETPLSAYRKLAANRPGTFLLESAEHGRSWSRWSFIGAGSPSALTVRDGEAGWLGVVPQDAPTGGDPLQALRATLDLLATGPLSGLPPLSGGMVGFFAYDLVRRLERLPELAVDDLGLPDMLLLLATDLAAVDHHEGTITLIANAVNWNGTDERVDEAYDDAVARLDVMTAALGQPLASTVATFERPEPRYRAQRSVEEYGKIVDYLVEQIAAGEAFQVVPSQRFEMDTDVDPIDVYRMLRVTNPSPYMYLLHVPNDAGGTDFSIVGSSPEALVTVADGVATTHPIAGTRWRGQTDDEDQLLEKELLADEKERAEHLMLVDLGRNDLGRVCAPGTVRVDDYSHIERYSHVMHLVSTVTGVLDAGRTALDAVTACFPAGTLSGAPKVRAMELIEEVEKTRRGLYGGVVGYLDFAGNADFAIAIRTALMRGGTAYVQSGGGVVADSNGPYEYTEATNKARAVLGAIAAAETLTEPGARR

SEQ ID NO: 3841 - protein, 152 aa, Mycobacterium paratuberculosis
MKPGDTVADFELPDQTGTPRKLSDLLAAGPVVLFFYPAAMTPGCTKEACHFRDLAAEFAAVGANRVGISADPVDKQAKFADLQKFDYPLLSDTDGAVAAQFGVKRGLLSKLLPVKRTTFVIDTDRTVLDVISSEFNMDTHADKALATLRARA

SEQ ID NO: 3842 - protein, 368 aa, Mycobacterium paratuberculosis
MSKWLSRNVLSWTVVVPVLAVVVLALIWGERLGPVLVALAALFLIGAVVAAVHHAEVVAHRIGEPFGSLVLAAAVTIIEVALIVELMASGGNETATLARDTAFAALMITTNGIAGLSLLLGSRRYGVTLFNAEGSGAALATLTTLATLSLVLPAFTTTQVGKEFSPGQLTFAAVASLLVYLLFVFTQTVRHRDFFLPIAQKGQKSLFEDESHADPPSTREALVSLVLLLCALVAVVGLAEEESPAVERAVTAVGFPQTFVGVIIAALVLLPETLAAVRAARQGRIQISLNLAYGSAMASIGLTIPAIALASIWLKGPLVLGLGAIQLVLLALTVVISVLTVVPGRATRLQGEVHLVLLAAYVFLAVSP

SEQ ID NO: 3843 - protein, 115 aa, Mycobacterium paratuberculosis
MTLDPQIAARLKRNADGLVTAVVQERGSKDVLMVAWMDDAALARTLETREATYYSRSRGQQWVKGETSGHTQYVHSVRLDCDGDTVLLTVDQVGGACHTGDHSCFDADVLLHPQD

SEQ ID NO: 3844 - protein, 265 aa, Mycobacterium paratuberculosis
MSPNSTGLAVRVIPCLDVDDGRVVKGVNFENLRDAGDPVELAAVYDAEGADELTFLDVTASSSGRATMLDVVRRTAEQVFIPLTVGGGVRTVADVDVLLRAGADKVSVNTAAIARPELLEEMARQFGSQCIVLSVDARTVPPGAVPTPSGWEVTTHGGRRGTGIDAVEWASRGADLGVGEILLNSMDADGTKAGFDLEMLQAVRSAVTVPVIASGGAGAAEHFAPAIEAGADAVLAASVFHFRELTIGQVKAAMAEAGIPVRMVR

SEQ ID NO: 3845 - protein, 266 aa, Mycobacterium paratuberculosis
MDLDALVARASAILDDASKPFLAGHRADSAVRKKGNDFATDVDLAIERQVVAALVEATGIGVHGEEFGGSAVDSEWVWVLDPVDGTFNYAAGSPMAGILLALLHHGDPVAGLTWLPFLDQRYTAVTGGPLRKNEIPRPPLTSIDLADALVGAGSFSADARGRFPGRYRMAVLENLSRVSSRLRMHGSTGLDLAYVADGILGAAVSFGGHVWDHAAGVALVRAAGGVVTDLAGRPWTPASDSALAAGPGAHAEILDILRNIGRPEDY

SEQ ID NO: 3846 - protein, 243 aa, Mycobacterium paratuberculosis
VLILLPAVDVVDGRAVRLVQGKAGSETEYGSALDAALGWQRDGAEWIHLVDLDAAFGRGSNRELLAEVVGKLDVRVELSGGIRDDDSLAAALATGCARVNLGTAALENPQWCARAIGEHGDKVAVGLDVQIIDGQHRLRGRGWETDGGDLWEVLERLERQGCSRYVVTDVTKDGTLGGPNLDLLGAVADRTDAPVIASGGVSSLDDLRAIATLTGRGVEGAIVGKALYAGRFTLPQALAAVAE

SEQ ID NO: 3847 - protein, 206 aa, Mycobacterium paratuberculosis
VTSKSVVVLDYGSGNLRSAQRALERVGASVQVTADADAAAAADGLVVPGVGAYEACMTGLRKIGGDRIIAERVAAGRPVLGVCVGMQILFARGVEFSVETSGCGQWPGSVTRLQAPVIPHMGWNVVESGPDSVLFRGLDADTRFYFVHSYAAQQWEGSPEAVLTWSRHEGPFLAAVEDGPLSATQFHPEKSGDAGAAVLRNWIERL

SEQ ID NO: 3848 - protein, 207 aa, Mycobacterium paratuberculosis
MTAVQAARRARIERRTKESDIVIELDLDGTGRVDVETGVPFYDHMLTALGSHASFDLTVRTTGDVEIEAHHTIEDTAIALGAALGQALGDKRGIRRFGDAFIPMDETLAHAAVDVSGRPYCVHSGEPDHLQHSTIAGSSVPYHTVINRHVFESLAMNARIALHVRVLYGRDPHHITEAQYKAVARALRQAVEPDPRVSDVPSTKGVL

SEQ ID NO: 3849 - protein, 398 aa, Mycobacterium paratuberculosis
VTGQRATPQPTLDDLPLRDDLRGKSPYGAPQLAVPVRLNTNENPHPPSRALVDDVVRSVARAAADLHRYPDRDAVQLRSDLARYLTAQTGVQLGVENLWAANGSNEILQQLLQAFGGPGRSAIGFVPSYSMHPIISDGTRTEWLQAARADDFSLDVDAAVAAVTERTPDVVFVASPNNPSGQSVSLSGLRRLLDAAPGIVIVDEAYGEFSSQPSAVQLVGEYPTKLVVTRTMSKAFAFAGGRLGYLIATPAVIEAMLLVRLPYHLSSVTQAAARAALRHADDTLGSVAALIAERERVSTALTGMGFRVIPSDANFVLFGEFTDAPASWQRYLDAGVLIRDVGIPGYLRATTGLAEENDAFLRASAQLAATELAPVNVGAIANAAEPRAAGRDRVLGAP

SEQ ID NO: 3850 - protein, 480 aa, Mycobacterium paratuberculosis
LYRPDIDLSSSGTMDTVSPTPASPMAGIDLRGAELTAARLRSALPRGGADVETVLPKVRPIVQAVAERGADAALEFGASFDGVRPAAVRVPEAALDKALADLDAAVADALRVMIDRARAVHADQRRTDVTTTLGPGATVTERWVPVERVGLYVPGGNAVYPSSVVMNVVPAQAAGVASLVVASPPQAQFDGLPHPTILAAARLLGVDEVWAVGGAQAVALLAYGGTDTGAEWPGFSSDRARSASSPGADAELVPVDMITGPGNIYVTAAKRLCRSRVGIDAEAGPTEIAILADHTADPAHVAADLISQAEHDEMAGSVLVTPSEDLAAATDAELAAQLPTTVHRERVTAALGGRQSAIILVDDLDAGITVVNAYAAEHLEIQTADAAAVAGRIRAAGAVFVGPYSPVSLGDYCAGSNHVLPTAGSARHSSGLSVQTFLRGIHVVDYTEAALKDVSGHVITLAQAEDLPAHGEAIRRRFER

SEQ ID NO: 3851 - protein, 137 aa, Mycobacterium paratuberculosis
MSAKDHPNNAPGVPMVFPVWFENLQVKYLNSAIKPLTRFLPGTATIKHRGRTSGKQYETIITPYRKGNTLAIALGHGKTNWVKNVLAAGEADVVFGRDRSVHLINPRILPAGSDGAGLPFMARVQLRWMGVFVADIA

SEQ ID NO: 3852 - protein, 284 aa, Mycobacterium paratuberculosis
MISDCELTAAREIIRRGLVEDLRYGPDVTTLATVPAEAVATASMVPRQPGVIAGVDIALLVLDEVLGARGYQVLDRVEDGAHLQPGQSLLTVRAETRGLLTAERTMLNLICHLSGIATTTAHWVAAVQGTKAQVRDTRKTLPGLRALQKYAVRVGGGVNHRLGLGDAALIKDNHVVAAGSVVDALRAVRDAAPELPCEVEVDSLEQLDEVLPEKPELVLLDNFPVWQTQMAVQRRDARAPAVLLESSGGLSLENAADYAATGVDYLAVGALTHSVRVLDIGLDM

SEQ ID NO: 3853 - protein, 530 aa, Mycobacterium paratuberculosis
MIARPQWTHSADVVVIGTGVAGLAAALAAHRAGRSVVVLSKADQARGATATHYAQGGIAVVLPHNDDSVEAHVADTVVAGAGLCDPQAVYSIVADGYAAVSELVGDGARFDESAPGQWALTREGGHSRRRIVHAGGDATGAEVQRALDHAARMLDIRTAHVALRVLHDGSMGDEAVTGVLVGNPHGCGIISAPSVILASGGLGHLYGATTNPEGSTGDGIALGLWAGVAVSDLEFIQFHPTMLFAPGAGGGRRPLVTEAIRGEGAKLIDSQGDSVTAGVHPMGDLAPRDVVAAAIDARLKATGDACVYLDARHIFDFADRFPTVTAACRAAGIDPVRQPIPVVPGAHYSCGGVVTDVYGRTELPGLFAAGEVARTGLHGANRLASNSLLEGLVVGGRAGRAAAAHAAEAGRPRALAPEPVAHTAPPRAELQAAMSRDASVVRDPAGLTRLSATLSQAPARSIGGRRDFEDVALAVAARAVAAAALARTESRGCHHREEHPQAAPEQARSNLLRLADDQNSVLVQALAAVV

SEQ ID NO: 3854 - protein, 349 aa, Mycobacterium paratuberculosis
MTVLNRMDTLAEDMVADITDSPTGYTGVDGDAQWAAEVRRLAKLRGATILAHNYQLPEIQDVADHVGDSLALSRIAAEAPEDTIVFCGVHFMAETAKILSPDKTVLIPDQRAGCSLADSITPEDLRAWKDEHPGAVVVSYFNTTAAVKALTDICCTSSNAVDVVASIDPDREVLFCPDQFLGAHVRRMTGRENLHVWAGECHVHAGINGDELGERARANPDAELFVHPECGCATSALYLAGEGAFPAERVKILSTGGMLDAANTTSARKVLVATEVGMLYQLRRAAPQVDFQAVNDRASCRYMKMITPAALLRCLVEGADEVHVDPGIAAAGRRSVQRMIEIGQPGGGE

SEQ ID NO: 3855 - protein, 241 aa, Mycobacterium paratuberculosis
MAHGSTAHEVLAVVFQVREASEPVTKGRHRAKPQLNVLLWQRAKDPQRGAWSLPGGRLRNDEDMTTSVRRQLAEKVDLKELAHLEQLAVFSDPNRVPGTRMIASTFLGLVPSPASPELPPDTRWHPVNCLPPMAFDHGQMVDNARARLIAKLSYTNIGFALAPREFALSTLRDIYGAALGYQVDATNLQRVLARRGVITATGTIAQSGRSGGRPAALYRFTDAALRVTDEFAALRPPGLPG

SEQ ID NO: 3856 - protein, 407 aa, Mycobacterium paratuberculosis; identical to SEQ ID NO: 2206

SEQ ID NO: 3857 - protein, 446 aa, Mycobacterium paratuberculosis
MAELGNLAGTHGAEWIARPPHEELQRKVRPLLPSDDPFYQPPLGFQHAEPGTVLRSRDVELAFLGLIPQPIKAVQLLYRTMDMNGEPEATVTTVIVPADAVPGRPCPLLSYQCAIDAVSSRCFPSYALRRRAKALGSIGQFELFLITAAVAEGWAVSVPDHEGLRGLWGAPYEPGYRVLDGIRAALGSERLGLSPSAPIGLWGYSGGGLASAWAAETCAEYAPELNVVGAVLGSPVGDLGNTFRRLNGSFLSGLPALVVAALAHIYPDLDRVIKEHANEEGRALLDSLEKMTTVEAVIRMAGKNMGDYLDAPLEQILSTPEVTYVFDHIRLGAAVPTPPVLIVQAVHDYLIDVHDIDVLADAYSAGGAQVTYHRDAFNEHMMLHPLSAPMTLRWLTDRFEGRPVTEHLIRTTWPTMFNPMTYVGMARLLKIAAKVVTGRKIHRRPL

SEQ ID NO: 3858 - protein, 196 aa, Mycobacterium paratuberculosis
VVAGSAVVGALLGALWAWIVPPVRAVVALTRSGERVHDYLGNESEHFFVAPTLLLGLLTVLAVVASVAAWQSRRHRGPATVAVLSVAMATAALIAAAVGAGLVRLRYGALDFDAVPLGRSPSVAYVIQAPPVFFSDGPLQIAVSLMWPAGIAALVYAVRAAADARDDLGALPPTAPTDARAAEAAVTAGGGESFGR

SEQ ID NO: 3859 - protein, 78 aa, Mycobacterium paratuberculosis
VVGDLGALGEVVGAGVYNVYTGELGGTAVPPAAQLGLEPPRFCAACGRRMVVQVRPDGWRARCSRHGQVDSAELETRR

SEQ ID NO: 3860 - protein, 344 aa, Mycobacterium paratuberculosis
VTQAATRPTAEIGNEDILAVARRQVLEGGQGLSRDQVLQVLRLPDDRLDDLLALAHEVRMRWCGPEVEVEGIISLKTGGCPEDCHFCSQSGLFASPVRSARLDIPSLVEAAKQTAKSGATEFCIVAAVRGPDERLLAQVAAGIEAVRNEVEINIACSLGMLTAEQVEQLAEMGVHRYNHNLETARSFFPNVVTTHTWEERWDTLSMVRDAGMEVCCGGILGMGETLEQRAEFAAELAELGPDEVPLNFLNPRPGTPFGDLEVMPATEALKSVAAFRLALPRTMLRFAGGREITLGDLGAKKGILGGINAVIVGNYLTTLGRPAESDLELLDDLQMPLKGLNASL

SEQ ID NO: 3861 - protein, 615 aa, Mycobacterium paratuberculosis
LGGTTMRSDELTIVAEAPARGAGLTQVIGLSLAAVVITLLMLWVGHAHRTHRIQWLTRIADKMGEKFHRPNWVALPVLIFTTSIICALFGFIWDVSWHIGNGRDPGPLANPAHYFIIIGLFGVFLGGMVSVVLPFDKPGPAAVRITRNWYAPVGGVLMAGCGLYAMIGFPLDDIWHRIFGQDVTLWGPTHLMMIGGAGFSLFAVLMLGREGEAAEGEDVYHSVFIRFLRYLSFGGMFIGLSVFQIEYDFGVEQFRLVLQPMMIAGAAALAAVAARITMGRGAALIAAVFAIALRGAVAVLVGPVLGAPLNWFPLYLGPALAVELVALTPIFKRPIVFGAVSGLGVGTLGLWLESLWISAVYHYPWPVSMWAEALAMAVPVAVLMGMCGAMFGMVLTGQRLPGRAIGISVVVATVLVIGGAVANGLHIVVPRQNNATILLTDLPSPPGQRMVSADIQLMPADMVSPDPEWVTVLSWQGRMQNHRGLQIDHLARVGPGHYRSTQPLPVWGTWKTLLRVQDGYTMTAVPIYEPADDAIPAAEVPALSAMNRPFVQEITILQRERDQNAPVWLFTAGSIVVLCLTLMVIASLTWGAGRLNNAVGRPEPVEDKQPIPRAA

SEQ ID NO: 3862 - protein, 120 aa, Mycobacterium paratuberculosis
MTLRGTLIAAWVAALTCGLVGCGGSPDKTAAAPLVIDVTIAQGQVTPTNATLQAKVHQQITLHVTSDATDELHVHSTPDHKFAVAAAPHQTFQFAVDVPGNVAVELHHLDRTIATIQIQP

SEQ ID NO: 3863 - protein, 454 aa, Mycobacterium paratuberculosis
VSPAPAAVVLAHGLGGSGDLPVPYAYAMVGAAWALTFTFALVAFAWRRPRFDPLKPGRALPAALTAFVDARATRYTAAGLALAVAAWAVAAGVWGPESDANALLGAFYVLLWVGLVAVSLAIGPVWRVISPIRTLYLLARRVVPERLARPRLSYPKRWGYRPAALGLFAFVWMELASPNPAAPSWVTGWLLIYTVLMAAGAWLCGQRWLARADPFGVYSMAVSRLSPFRRNPRTGRIVVGNPLDHLPSLPVRPGVVVLLAVLLGSTAFDSFSSSPTWRGFSDRLTREFAAPPALASSVLRTLGLIVFICVVALTFSLAARATGGVDAQQRRALPGQMAHSLIPIVVGYIFAHYLSYLVERGQQAVFALADPFGRGWNPLGLAHLQVAYVLSMHPPVLAAIKVTCVVTGHIVAVIAAHDKALRLLPAGHQLTGQLAMMLVMVGYTFTGLYLLFGG

SEQ ID NO: 3864 - protein, 730 aa, Mycobacterium paratuberculosis
MARRSREQPAPDPQQPARQAGRRRPGLSWISIQSKVMVMLLVSSLASLGVIGTVEYVAARNALQPAASERMVQLREAQKRAIETLFSDLSDSLVVYSRGSTALEAVQAFTAGFDQLANAPVDPAQQRALVDFYTERLIKPVERDTGKKLALDAVLPADNAQRYLQAHYTVVAGGPFEGTGSAPDDAGDGSAWSAANARFNDYFREIATRFEYRDALLLDTRGNVVYSVRKSASLGTNILTGPYRQSNLRGAYEKAMAANSVNFVWITDFQPYQPQLGQPTAWLVAPIGAPGRAAGVLALPLPIAKVNRIMTADKQWRAAGMGRTAETYLAGPDNLMRSASRLILEDPERYARDAVAAGTPRNTVDTAIRWGGTTLVQPVATAAVRAAQRGETGTVTDTGYLGRRELAAYAPLSLPNSDLHWSILATRETAEANARVVSLTQTLVLTTTAMVFVICVAALLVAQMFVRPIRRLQAGAREISAGNYDVTIPVTSRDEIGELTAAFNDMSRNLQIKQELLGEQRKENDRLLASLMPEPVARRYREGEQTIAQEHQDVTVIFADIVGLDEISAKLSGRELVGVVDELVREIDSAAETLGVEPIRTLHNGYLASCGLNVPRLDSVQRTVEFAVEVQGIIARFNGRTGYHLGLRAGINTGNVVSGLVGRSSLVYDMWGAAVNLAHQTRSSTTQTGIYVTSKVCEVMRDIRHFTPAGTVTVGGVEQQIWQLSERTGP

SEQ ID NO: 3865 - protein, 370 aa, Mycobacterium paratuberculosis
VSTFDSSSLYWAAAVVLGLPLLLIVFTEWHQSLVRKHSPLARPVFLLRSYLIPLGALLVLLVNVARMPAQFTSVRVLATAFGFVVVVLLLSGLNATVFEGAPEGSWRQRVPGIFLDVTRFVLIGVGLAVIFSYVWGVRVGGLFTALGVTSVVIGLMLQNSVGQIVSGLFMLFEQPFRIGDWLDTPAARGRIVEANWRSVHIQTGRGLQITPNSVLATTSFTNLSRPPGGHQLTLTATFSETDPPDRVCALLRRVADALPQRRPDAVAAAVSAGGAEYHVTIGLTSPADDSAAQATLLRCSGTARAARVCASTAPRTTSPPPSASSGRCAWWSPRRCGWARRISRRWCRTPESSGTGPTRSSSTPAASRRR

SEQ ID NO: 3866 - protein, 100 aa, Mycobacterium paratuberculosis
MVVAPALRLGPPDQQALVSHARIVRYGADEIVEHAGRVPEKMTFLLAGGVRLTAAAPDGSVVAVGGLDEGSFLGVTALTRQPNLADAQAVAGDRAGDRPR

SEQ ID NO: 3867 - protein, 169 aa, Mycobacterium paratuberculosis
MVHSIELVFDPDTEAAIRQTWKALAAAGIPSQAPASRPHVTLAVADAIAADVDALLAPLCTRLPLPCLIGAPVLFGRGSVVFARLVVPTGELLDLHAQVHRLCAPHLRPAPMPNSLPGQWTGHVTMARRVGGAQLGRALRIAGRPTQIECSFVGLRRWDGNKKVEHPIG

SEQ ID NO: 3868 - protein, 235 aa, Mycobacterium paratuberculosis
MCSPGSAEAVTVLVVTGTDTGVGKTVATAALACHARQAGIDVAVCKPVQTGTDDGDDDLAEVARLSGVTELAGLARYPRPLAPVAAAAAAGMALPSREQLLGFIGELDRPGRLTLVEGAGGLLVELGENGVTARDLAVALGAAVLVVVRPALGTLNHTALTLEALAAQGLSCAGLVIGAWPEHPGPVETSNRPALEALAPVRAVLPAGAAALAAAEFEAVSAGAFDRDWVTALAG

SEQ ID NO: 3869 - protein, 381 aa, Mycobacterium paratuberculosis
MKAPIEVSPLAWLDAVEQQRRAAGLRRSLRPRPPVATELDLASNDYLGLSQHPDVIDGGVAALRMWGAGATGSRLVTGDTELHQQFESELADYVGAASGLLFSSGYAANLGAVVGLSGRGALVVSDAYSHASLVDACRLSRARVVVTPHRDVDAVRAALQDRDEERAVVITESVFSTDGALAPLRELHEVCRRHRALLIVDEAHGLGVRGGGRGLVFEAGLAGAPDVVMTTTLSKALGSQGGAVLGPAAVRAHLIDAARTFIFDTGLAPAAVGAARAALGVLRAEPWRSGAVLRHAGVLAEVCRVREAPQSAVVSVILGDPDVAVAAATACLDGGVRVGCFRPPTVPAGTSRLRLTARASLDDAELEVARRVLTDVLAGLG

SEQ ID NO: 3870 - protein, 438 aa, Mycobacterium paratuberculosis
MPAAKAGLTPEQISAIDAAHLWHPYSTIGAESVAPVVAVGARGAWLTLIRDGAEVRALDAMSSWWTAIHGHGHPVLDAALSDQLAAMNHVMFGGLTHEPAARLAQLLVSITPAGLDTVFFSDSGSVSVEVAVKMALQYWRSRHRPAKHRLMTWRGGYHGDTFTPMSVCDPEGGMHSLWTDILARQVFAPQVPRDYDPAYSAAFEAQLARHADELAAVIVEPVVQGAGGMRFHDPRYLGDLREACTRRDVLLIFDEIATGFGRTGELFAADHARVSPDIMCVGKALTGGYLSLAATLCSTDIAQVISAGEAGALMHGPTFMANALACAVSMASVEVLLGQDWRSRVAEISAGLAAGLEPARELPGVTDVRVRGAIGVIECDRPVDLAVATPAALDHGVWLRPFRNLIYAMPPYICPPDEIARIASAMVQVAARLGSRRL

SEQ ID NO: 3871 - protein, 95 aa, Mycobacterium paratuberculosis
LLATATSWPERLFGFLANVCEDETCGPVPYGLDLYIHPVVWGGIGAALTAAVVGPVVSLLKGWYMSFWPVLSLALVMVSSVAGSMLTMFSERYWL

SEQ ID NO: 3872 - protein, 316 aa, Mycobacterium paratuberculosis
VRSQRGGPRPVHEPGRTREVTAPRPDECRRGQERPGKMKRIYAFAIGLALLGAPAAPMVVPPVATADPGVRAMDYQQATDVVIARGLSQRGVPFSWAGGGINGPTRGTGTGANTVGFDASGLMQYAYAGAGIKLPRSSGAMYRVGQKILPQQARKGDLIFYGPEGTQSVAMYLGNNQMLEVGDVVQVSPVRTAGMAPYMVRVLGTTAPTQQVPQQAPLQQTPAQQAPLQQTPGQQAPLQQTPGQQLPTQQAPLQQVPGQQVPGQQLPTQQAPQQAPLQLAPTQQAPLQQLPTQQSPLQQLPVQQSPLQPAGAGLTR

SEQ ID NO: 3873 - protein, 721 aa, Mycobacterium paratuberculosis
MQTPSPSPAPVAAADPGTSGARTPGSRGFYRYDLDGLRGIAIALVAVFHIWFGRVSGGVDVFLALSGFFFGGKVIRAALNPAVALSPVAEVIRLVRRLVPALVVVLAGCAVLTILVQPETRWETFADQSLASLGYYQNWELANTASDYLRAGEAVSPLQHIWSMSVQGQFYVSFLVLIAGLAYLFGRPLGARLRTLVLVVLAALTVASFGYAIVAHQQNQAAAYYDSFARGWELLLGALVGALVPRIRWPMWLRTLLATVALGAVLSCGALIDGVQEFPGPWALVPVGAAMLMILVGANLGADGRLPLPNRLLATRPLVELGAIAYSLYLWHWPLLIFWLSYSGHKHAGFVEGTVLLLVSGVLAYLTNRLVEDPLRHRGSARPAPRPAAPTVPWLARVPRPTMALGSAIVLLGVTLTATSFTWRQHVTVLRSAGKELSVLNPQDYPGARALTEHVRVPTLPMRPTVLEVKQDLPASTRDGCISDFVNPAVVNCTYGDVTADRTIALAGGSHAEHWLPALDMLGKLHHFKVVTYLKMGCPLSTEQVPLIMGNNAPYPQCREWVQRTMTKLVTDRPDYVFTTTTRPWNIKTGDVMPATYIGIWQTLSDNNIPILGMRDTPWLVKNGQPFDPADCLAKRGSTAQSCAIKRSDVLSERNQTLDFVGQFPQLKVLDMSDAICRADVCRPVEGNVLIYHGAHHMSPTYVRTMAPELGRQIAESTGWW

SEQ ID NO: 3874 - protein, 732 aa, Mycobacterium paratuberculosis
VSSNEPASAAGGGTHQPEVPTVWPGSPYPLGASYDGAGTNFSLFSEIAEKVELCLIDSRGAETRIPLDEVDGYVWHAYLPNINPGQRYGFRVYGPFEPSAGHRCDPSKLLLDPYGKAFHGDFTYGQALFSYDLKAVAAGGDDADPGIPPMVDSLGHTMTSVVSNPFFDWGSDRAPLTPYHETVIYEAHVKGMTQTHPSVPEQLRGTYAGLAHPAIIDHLKSLNVTAIELMPVHQFMHDSRLLDLGLRNYWGYNTFGFFAPHNQYAANRNSSVAEFKSMVRSFHEAGIEVILDVVYNHTAEGNHLGPTINFRGIDNAAYYRLVDTDLRRYKDYTGTGNSLNPRHPHVLQLIMDSLRYWVTEMHVDGFRFDLAATLARELHDVDRLSAFFDLVQQDPIVSQVKLIAEPWDVGEGGYQVGNFPGLWTEWNGKYRDTVRDYWRGEPATLGEFASRLTGSSDLYEATGRRPSASINFVTAHDGFTLNDLVSYNEKHNMANGEDNRDGESHNRSWNCGVEGPTDDPDITELRYRQMRNFWATLMVSQGTPMIAHGDEFGRTQNGNNNVYCQDSELSWMDWSLVDKNSDLLAFARRATTLRTKHPVFRRRRFFEGEPIRSGDEVRDIAWLTPGGREMTHEDWGQSFHKCVAVFLNGDAITAPNARGERVVDDSFLLCFNAGEQPVQFVMPGGDYAKEWTVELDTNEPTGRKEGAEPLVVHTEEELTLPSRSLLILRKTL

SEQ ID NO: 3875 - protein, 766 aa, Mycobacterium paratuberculosis
MGLPVLSSYRLQLRGESSGFAFTFADAEHLLDYLDALGVTHLYLSPIMTATAGSSHGYDVTDPTTVSAELGGRDGLARLSAAARARGMGLVVDIVPNHVGIDAPRQNPWWWDVLRNGRSSPYATFFDVDWDLDEDGRIVLPVLGSDDDAADLTVDGELLRLGDLAFPIAPGTAGGTGPEVHDRQHYRLVGWRNGVCGYRRFFSITSLAGLRQEDPAVFAATHAEVGRWFAEGLVDGVRIDHPDGLSDPCGYLTRLRELVGPDAWIVIEKILAADEALEPTLPVAGTTGYDVLREIGGVLLDPNGAPALTALVDSSGVDYQAMPKMLAELKIHAATVTLASELGRLRRSIAAAADVDHPLLHEAIAALLTNIGVYRCDYPGLVALLPTALAETQSAAPHLGPALQVLAAALARGGEPATRLQQLCGAVTAKAVEDCLFYRDARLVSLNEVGGEPHRFGVGAAEFHHSAATRARLWPHTMTTLTTHDTKRGEDVRARIGVLSQVPSLWTEFVARWEVAAPSPNPATGQFLWQNIFGVWPVTGEVTAALRERLHGYAEKAIREAAWHTSWNDPDADFEDAVHRWLDTVLDGPVAGQLTELVAQLNPHASSDALAQKLLALTVPGIPDVYQGTELWDDSLVDPDNRRPVDYRARRAALQALQHPKIRVVTTVLRVRRAHPDTFLHGDYAPLLADGDACDHVLAFTRGADIVVAVTRWTVRLAEKGWGNTVLPLPDGTWKDALTGSVVDGPTSAAQLFAELPVVLLERHHD

SEQ ID NO: 3876 - protein, 590 aa, Mycobacterium paratuberculosis
MTEQKTEFRVWAPKPARVRLDVEGRPHAMTRTDDGWWHAAVACAPDARYGFLLDDDPTVLPDPRSPRQPDGVHTRSQLWDPAAATWTDSAWPGRSTHGAVIYELHLGTFTAAGTFDSAIEKLDYLVDLGVDFVELMPVNSFAGTHGWGYDGVLWYSVHEPYGGPDGLVRFVDACHARGLGVLIDAVFNHLGPSGNYLPRFGPYLSSASNPWGEGINIADADSDEVRRYIIGCALRWMRDFHADGLRLDAVHALVDTTAIHILEELSTETDWLATQLGRPLSLIAESDLNDPRLITARERGGYGLTAQWADDIHHAIHTAVSGERQGYYADFGSIATLAHTLRHGYFHAATYSSFRRRRHGRPLDTSAQTGIPATRLLAYTCTHDQVGNRALGDRPSQNLTAGQLAVKAVLALLSPYTAMLFMGEEYGASTPFQFFSSHPEPELARATAEGRKTEFAEHGWDASKKGEIPDPQDPQTFARSKLNWDEVGTGEHARLHRLYRDLIALRHNDPDLADPWLEHLTVDYDEDQRWIVLARGRLRIVCNLGAEPVTVPVGGELMLAWDEPTVDADTTVLQGHSFAILSTPGQPVDN

SEQ ID NO: 3877 - protein, 442 aa, Mycobacterium paratuberculosis
VAVHKSITATGAESIAASIEAAISAGSLAPGDALPPVRELAARLGVNANTAAAAYRLLRHRGAVETAGRRGTRVRHRPATTPRSLLGLDVPAGVRDLSTGNPHPALLPLAAAAPARPASGRAVLYGEPAISPALGEYARAALSADGVPADHLALTSGALDGIERALTAHLRPGDRVAVEDPGWANLLDLLAALGFSAEPVRVDDDGPLPEDLARALGRGARALVLTTRAQNPTGAALSADRAAALRDLLSGRADDVLLVEDDHCAGISGAALHPVAGCTAHWAFVRSASKAYGPDLRVAVLAGDQRTVDRVHGRLRLGPGWVSHVLQQLAVELWSDTAASELVATAERRYADRRRRLCGALAERGVDAHGRSGLNVWVRVPDEAVAVSRLLGAGWAAAPGARFRMQTPAGIRITIADLTPDEIEPLADAVAQAVRPSGRPIV

SEQ ID NO: 3878 - protein, 177 aa, Mycobacterium paratuberculosis
MSTEADYQPTPRSTPTRYRERARYDRRTVHRILDEALICHLGYLSGGRPVVLPTTHARRGETLYLHGSTGGGPVLAARAAAAAGAGLPVCVTVTLVDALVLARAAMHHSVNFRSVVVLGDARVVDDPAEKSRALSRLLDHIAPGRAADCRAADARELAATGVLALDLAEVSAKVRSG

SEQ ID NO: 3879 - protein, 219 aa, Mycobacterium paratuberculosis
VALLLGLAAVALLAVGFTEVLDDVLEGDGIAVIDHPVTRWLAAHRDLWLTTVLQAITVAGGPLFLAALALPISVVAAWRSRSWRPVLLAVVAGAGVPVMLFTAKALVGRHRPPLPFALVDADGYSFPSGHATGTAAMMAISAWLLTRWLIPGWTGRVLVWALAIGAVLLIGFSRIYLGVHYLSDVLSGWMLGTAWAFAVMLVGTWWDNTRPARERQRQV

SEQ ID NO: 3880 - protein, 427 aa, Mycobacterium paratuberculosis
VSAELSQSPSVAPLSAADIDDAAKRIAAVVTPTPLQFSDRLSAITGAQVYLKREDLQIVRSYKLRGAYNLLVQLSETELAAGVVCSSAGNHAQGFAYACRMLQVHGRVYVPAKTPLQKRDRIRYHGGEFIELIVGGTTYDQAAEAALADVASTGATLVPPYDDLRTIAGQGTIAVELLDQLDTEPDLVVVPVGGGGCIAGITTYLAERTDTTAVLGVEPAGAAAMMAALAAGEPVTLDHVDQFVDGAAVRRAGDLTYAALAAAGDMVSITTVDEGAVCTAMLDLYQNEGIIAEPAGALSVTGLLEADIEPGSTVVCLISGGNNDVSRYGEVLERSLVHLGLKHYFLVDFPQEPGALRRFLDEVLGPNDDITLFEYVKRNNRETGEALVGIQLGSSADLDGLLARMRATELHVETLKPGSPAYRYLLL

SEQ ID NO: 3881 - protein, 145 aa, Mycobacterium paratuberculosis
MPLSGEYAPSPWDWSREQADKYVASGGAEAADMKDKPIIVLTTVGAKTGKLRRTPLMRVEHDGQYAVVASLGGAPKNPVWYHNIKKNPRVELQDGPVTREYDAREVFGDEKAVWWQRAVEAWPDYAEYQTKTDRQIPVFVLTPVA

SEQ ID NO: 3882 - protein, 262 aa, Mycobacterium paratuberculosis
MTEQSEGPQRPLIGYITHDIAPQIAPAPIGRAWMSQMRQGWPHRCLPMLIANQSGWEVRNRSAFTATWMGGDDRTSLTIVPDTRASGQFLPDSHFGFGILTWHLPILFRTPPGYNLLVRGPANHPKDAISPLEGIVETDWSSSSFSMNWKFTREFMPVRFEVDEPICMIVPQRRAELEEFAPELRPIESDEELHRKHEFFLSSRGALGREQEVADERVPWQGDYTRGRHSDGEPGAPDHQTRRRLRSFVARPAVGPPHPDRA

SEQ ID NO: 3883 - protein, 633 aa, Mycobacterium paratuberculosis
MTGGPAGSAREIGRVGMRKLLQRTGILDEATSPLATDPAEVVQLLGAPWYDERLRTLAGELGRDPANVRAEAAGYLREMAASLDESAVAAWRGFSRWLMRAYDVLIDEDQIAALRKLDRKATLAFAFSHRSYLDGMLLPEVILANRLFPALTFGGSNLNFFPMGAWAKRTGAIFIRRQTKDLPVYRFVLRAYAAQLVQNHANLSWSIEGGRTRTGKLRPPVFGILRYLADAVDEIDGPEVYLVPTSIVYDQLHEVEAMTTEAYGAAKRPEDFRFLIRLARQQGTRLGRAYLDFGEPLPLRKRLEELRAEESGSQTEIERIALDVEHRINRATPVTPTAVVSLALLGADRSLTLSEVLATVRPLASYIAARNWVVAGAADLTNRSTIRWTLHQLVASGVVNVYDAGTEAVWGIGTDQHLVAAFYRNTAIHILVDRAIAETALLAAVEVSETSGDGSVLPATVRDEALKLRELLKFEFLFSARAQFEKELADEVRLIGPAEDPVDTGKAASAAVVRGLLEQADLLLAHLVLRPFLDAYHIVADRLACYEDDSFDEQAFLAECLQVGKQWELQRRIANAESRSMELFKTALRLARHRELVDGFEDPDIARRRRQFADEIATAIRRVNTIAELARTR

SEQ ID NO: 3884 - protein, 606 aa, Mycobacterium paratuberculosis
MTAERPATLCEAFQRNAAIDPDAVVLRTPGATQTLTWRELAEQVRKFAAGLAGLGVRRGDTVSLMMANRIEFYPLEIGAQHLGATSFSVYNTLPAEQLTYLFDNAGTKVAICEQQYVDRIRASGAPVEHIVCIDGAPPGTISVEQLYAAAPRDFDFESTWRSVRPDDVVTLIYTSGTTGNPKGVEMTHANLLFECHALNAVLPSKFGDRVTSYLPSAHIADRAMGLYGLEVFGAQVTVVDDPRAIAAALPDVRPTVWAAVPRIWEKLKAGIEFTVANEQDESTRAALQWAMSVAAQRAAALVAGEQIPDELAAEWARADELVLSKLRERLGFGELRWAVSGAAPIPKETLAFFAGIGIPIAEVWGMSELSCVAAVSHPRDARLGSVGKLLPGLEGKIADDGEFLVRGPLVMKGYRKEPAKTAEAIDADGWLHTGDILEADAQGYLRVVDRKKELIINAAGKNMSPANIENAILAACPMIGVMITIGDGRPYNTALLVFDADSVGPYAARHGLSDASPAALAADPDVIAQIAAGVAAGNAKLSRVEQIKRFRILPTLWEPGGDEITLTMKLKRKPIMAKYAEEIEQLYADPPPPEVHEPAATAVQPA

SEQ ID NO: 3885 - protein, 158 aa, Mycobacterium paratuberculosis
MAPVNDLELTLSQARTREPPMLTIGEVARRSGVAATTLRYYEQIGLLPAPIRLGGQRRYDEAVLSRLEVIALCKTAGFALDEIQRLFADDAPGRPASRALARAKLAQIDAQLESLARARAVIEWGMRCTCPSIDACTCGIHPTRPAPVGPDVRSARRF

SEQ ID NO: 3886 - protein, 152 aa, Mycobacterium paratuberculosis
LTGAMPHRSFAELHTDRYALLRSFRRDGTPVDTPIWFAVDDDGVLFRTKVGPKTRRLAAHAGVELAACDYRGRVRPGATTLAGRATILSGADAERANRLLHRRYGWQWNIVPLLKIPGVTNVHRDLCLREKLRRARDRGVWPDSVIVRVQPM

SEQ ID NO: 3887 - protein, 1177 aa, Mycobacterium paratuberculosis
MNHSSFVHLHNHTEYSMLDGAAKITPMLAEVERLGMPAVGMTDHGNMFGASEFYNAATKAGIKPIIGVEAYIAPGSRFDTRRILWGDPSQKADDVSGSGSYTHLTMVAENAAGLRNLFKLSSLASFEGQLGKWSRMDAELIAEHADGIIATTGCPSGEVQTRLRLGQDREALESAAKWREIFGADNFFLELMDHGLSIEQRVRDGLLEIGRKLNIPPLATNDCHYITRDAAHNHEALLCVQTGKTLSDPNRFKFDGDGYYLKSAAEMRQIWDAEVPGACDSTLLIAERVQSYAEVWTPRDRMPVFPVPEGHDQASWLHHEVMAGLRRRFPDGVGQDYIDRAEYEIKVICDKGFPSYFLIVADLINYARSVDIRVGPGRGSAAGSLVAYALGITNIDPIPHGLLFERFLNPERPSAPDIDIDFDDRRRGEMVRYAADKWGSDRVAQVITFGTIKTKAALKDSARIHYGQPGFAIADRITKALPPPIMAKDIPLSGITDPSHERYKEAAEVRGLIETDPDVRTIYQTARGLEGLIRNAGVHACAVIMSSEPLTEAIPLWKRPQDGAIITGWDYPSCEAIGLLKMDFLGLRNLTIIGDALDNIKANRGIDLDLESVPLDDKATYELLGRGDTLGVFQLDGGPMRDLLRRMQPTEFNDIVAVLALYRPGPMGMNAHNDYADRKNGRQPIKPIHPELEEPLREILAETYGLIVYQEQIMFIAQKVASYTMGKADALRKAMGKKKLEVLEAEYKGFYEGMTANGFSEKAVKALWDTILPFAGYAFNKSHAAGYGLVSYWTAYLKANYPAEYMAGLLTSVGDDKDKAAVYLADCRKLGITVLPPDVNESLVNFASVGQDIRFGLGAVRNVGANVVGSLIKTRNEKGKFTDFSDYLNKIDISACNKKVTESLIKAGAFDSLKHARKGLFLVHTDAVDSVLGTKKAEAMGQFDLFGGDGGCTESVFTIKVPDDEWEDKHKLALEREMLGLYVSGHPLNGVAHLLAAQVDTQIPAILDGDVPNETQVRVGGILASVNRRVNKNGMPWASAQLEDLTGGIEVMFFPHAYSTYGADIADDAVVLINAKVAIRDDRIALIANELVVPDFSTAQVDRPLAVSLPTRQCTIDKVTALKQVLARHPGTSQVHLRLISGDRITTLELDASLRVTPSPALMGDLKELLGPGCLGG

SEQ ID NO: 3888 - protein, 143 aa, Mycobacterium paratuberculosis
MAAVEMTAEVPMSPQQMWDRVSDLSELGDWLVLHEAWRGELPDELGEGTQVVGVARAKGFRNRVTWTVTTWEPPHRVAMTGSGKGGTKYAVSLTVRPTGDGSTLGLRLELGGRALFGPVGSAAARAVKGDVQRSLRNFVELYG

SEQ ID NO: 3889 - protein, 267 aa, Mycobacterium paratuberculosis
MSLPKPDIATTVVITGASSGIGAELARGLARRGFPLLLVARRRERLDDLANEVGGQYSVGVEVLPLDLGDSKARARLAGRLRSESIAGLCNSAGFGTSGVFHELPMERESEEVTLNALALMELTHATLPGMVSRGAGAVLNIASIAGFQPVPYMAVYSATKAFVQTFSEAVHEELHGSGVSVTCLCPGPVPTEWAEIANAERFSIPIAQVSPRDVAEAAIGGMLTGRRTVVPGVVPKVVSTGGRFAPRSLLLPGIRIGNRFRGGPKR

SEQ ID NO: 3890 - protein, 161 aa, Mycobacterium paratuberculosis
MRERGFGQIINVSSVGVQTRAPRFGAYIASKAALDSLCDALQAEVVNDNVKFTTVHMALVRTPMISPTTLYDKFPALTPEQAAGVIADAIVHRPRRASSPFGQFAAVADAVNPAVMDRVRNRAFAMFGDSSAAKGDESATDATEFDARSETFVRATRGIHW

SEQ ID NO: 3891 - protein, 313 aa, Mycobacterium paratuberculosis
MNLGDLTNLVEKPLAAVSNIINTPNSAGRYRPLYLRNLLDAVQGRTLEEAVDAKTVLITGASSGIGEAAAKKIAEAGGVVALVARTRENLEKVASEIRENGGSAHVYPCDLSDMDAIAAMADRVLDDLGGVDILINNAGRSIRRSLELSYDRIHDYQRTMQLNYLGAVQLILKFIPGHARARLRPDHQRVVGRGADPRAAVRGVHRQQGRAGQPVRRAAGRSRQRQRQIHHRAHGAGAHPDDQPDHVVRQVPGADARAGGRGDRRRDRAPAAAGQLAVRAVRRRRRRGQPGRDGPGAQPGVRHVRRLQRRQGR

SEQ ID NO: 3892 - protein, 136 aa, Mycobacterium paratuberculosis
MKILARFRKAEPASIYDRIGGHEALEVVVENFYVRVLADEQLSGFFTGTNMNRLKGKQVEFFAAALGGPHPYTGAPMKQVHQGRGITMHHFGLVAGHLADALTAAGVPSETVSEILGAIAPLAPEIATGEAGKVTV

SEQ ID NO: 3893 - protein, 252 aa, Mycobacterium paratuberculosis
MGRTFDELIAEADSVPVEGWDFSWLNGRATEERPSWGYQRLLSRRLANVSAALDIHTGGGEVLAGAAPFPPTMAAIQTWPPNAALATARLHPLGAVVVAVGDEPPLPFADHAFDLVTSRHPVSVWWSEIARVLRPGGSYFAQHIGPATMGELVEYFIGPQPQKWAEFHPDAVRAQVAAAGLRVVDVRMERLRAEFFDIGAVVYFLRKVIWTVPDFSVARYRDRLAELHERIESQGLFVAHPTRVLVESRKPE

SEQ ID NO: 3894 - protein, 308 aa, Mycobacterium paratuberculosis
VTERSMPVPEGLAGMRVDAGLARLLGLSRSAAAALAEDGGVELDGVPAGKSDRLTGGAWLHVRLPEAPAPPQNTPVDIEGMTILYSDDDIVAVDKPAAVAAHASVGWTGPTVLGGLAAAGYRITTSGVPERQGIVHRLDVGTSGVMVVALSERAYTLLKRAFKQRTVDKRYHALVQGHPDPSSGTIDAPIGRHRGGEWKFAVTKDGRHSLTHYDTVEAFVAASLLDVHLETGRTHQIRVHFSALHHPCCGDLVYGADPKLAKKLGLQRQWLHARSLSFAHPADGRRMEIVSPYPPDLQHALDVLRDEG

SEQ ID NO: 3895 - protein, 184 aa, Mycobacterium paratuberculosis
MSVPEQPTGSTAPHDRPPRRLRLLLSVAATVLALDIVTKVLAVKLLPPGQPVPIIGDTVTWTLVRNSGAAFSMATGYTWVLTLIATGVVVGIFWMGRRLVSPWWAVGLGMILGGAMGNLVDRFFRAPGPLRGHVVDFLSVGWWPVFNVADPSVVGGAILLVVLSIFGYDFDTVGRRKKADQSRD

SEQ ID NO: 3896 - protein, 319 aa, Mycobacterium paratuberculosis
MRDDSPMARLTVIATGGTISTGTGADGVHRPCYSGADLTAPFRADHDVEVVDLLAVDSSELTLADWDRMRGAVTGALDGGGADGVVILHGTDTMEETALWLDLTYDGPAPVVLTGAMRSADAPDADGPGNVRDALAVAAHPAARGLGVLLCFAGRVLQPLGLSKVATEDLSGFAGRLVGTVAGDVALTGPKTRPYLGDLGAAAAPRVDIVAAYLGSDAVALDACVAAGARAVVLEALGSGNAGPAVVDAVRRHCGTGVVIAVSTRVPGGRVGASYGPGHEMAAAGAVPVPTLRPPQARVLLIAALAAGLPAADVLGRWG

SEQ ID NO: 3897 - protein, 463 aa, Mycobacterium paratuberculosis
VESRWVLHLDMDAFFASVEQLTRPTLRGRPVLVGGLGGRGVVAGASYEARVFGARSAMPMHQAKRLVGVSAVVLPPRGVVYGVASRRVFDTIRAVVPVVEQLSFDEGFGEPAQLAGAPAQDVEAFCEQLRRRVREQTGLIASVGAGSGKQIAKIASGLAKPDGVRVVRRAEERELLGGLPVRRLWGIGPVAEEKLHRLGIETIGELAALTDAEAANILGATIGPALHRLARGIDDRPVAERAEAKQISSESTFAADLTTLEQLREAIEPIAEHAHHRLLRDGRGARTVTVKLKKSDMSTLTRSATLPYATTEAAALVGVARRLLLDPREIGPIRLLGVGFSGLSEVRQESLFPDLEMPAPQSDSQSVETAAEAMFGPGHDAGWRVGDDVAHPDLGHGWVQGAGHGVVTARFETRTSGPGPARTFPADSAELVRANPVDSLDWPDYVEGLQESSAPPAEDVGGR

SEQ ID NO: 3898 - protein, 286 aa, Mycobacterium paratuberculosis
MGEGQLFVGTEALSAGALTERDLRRSCTRIYRNVYQRGADFTASDRAIAAWLWSGRRAVVAGNSAAALLGAQWVDPRAPAELITDRKRPPPLIVARNETLLPDEITEVRGVPVTTPARTAYDLGRRPGSVAAVIAIDSMARATGLTTECVEPLMRAHRGARGVRQLRRVLPLIDAGAESPQETRTRLAIVGAGLPKPSTQITVHNDWGFVLARIDLGWEQWRVGVEYDGAQHWTDPRIRAKDIDRVAELERRGWRIIRVSADLLRNRPDVLVGRIREALRAAGCPL

SEQ ID NO: 3899 - protein, 1053 aa, Mycobacterium paratuberculosis
VTDNLGFQADREAQPADSVQTYPKPAGGAPDFPALELEVLDYWARDDTFRASIARRDGAEEYVFYDGPPFANGLPHYGHLLTGYVKDIVPRYRTMRGNKVERRFGWDTHGLPAELEVERQLGITDKSQIDDMGIAAFNDACRESVLRYTDEWRAYVTRQARWVDFDHDYKTLDLPYMESVIWAFKQLWDKGLAYEGYRVLPYCWRDETPLSNHELRMDDDVYPSRQDPALTVGFKVVGGELDGAHLLIWTTTPWTLPSNLAVAVHPEVTYVQVRSGDRRFVLAQPRLAAYARELGPEPEILGSYRGAELLGTRYLPPFPYFMDNPNAFRVLAGEFVTTEDGTGIVHLAPAYGEDDMAVADAAGIAPVTPVDSNGRFDAAVPDYQGLNVFDANPQIIWDLKNGSGAAAANAPVLLRHETYEHPYPHCWRCRNPLIYRAVSSWFVAVTRFRDRMVELNQQITWYPEHVKDGQFGKWLAGARDWSISRNRYWGTPIPVWKSDDPAYPRIDVYGSLDELERDFGVRPDNLHRPYIDELTRPNPDDPSGRSTMRRIPDVLDVWFDSGSMPYAQVHYPFENRDWFETHYPGDFIVEYIGQTRGWFYTLHVLATALFDRPAFKTCVAHGIVLGSDGQKMSKSLRNYPDVSEVFDRDGSDAMRWFLMASPILRGGNLIVTEQGIRDGVRQVLLPFWNAYSFLALYAPKIGTWRTDSPQVLDRYILAKLAELRDDLTREMDACDISRACEQLRQFTEALTNWYVRRSRSRFWSEDADAIDTLHTVLEVTARLAAPLLPSVTELVWRGLTGGRSVHLTDWPRSGELPADPGLVAAMDQVREVCSAASSLRKAKKLRVRLPLPKLTVAVENPQHLAPFVDLIADELNVKSVELTDAIDTYGTFELTVNARVAGPRLGKDVQAAIKAVKAGEGVVNADGTLTAGPAVLRPEEYSSRLVAADPEFTAALPNGAGLVVLDGTVTPELEAEGWAKDRIRELQELRKSTGLDVSDRISVVMSVPAGRAEWARTHRDLIAGEILATRFEFGEPADPVAIGDGVRVSISKV

SEQ ID NO: 3900 - protein, 78 aa, Mycobacterium paratuberculosis
MTAAFYDEVAAVAPAPTLRVVRDTDTIAAPAPKTRRGSGAPFGAGGDPLVDGAARLLSIPLRHVYAALWRVGVLEVQA

SEQ ID NO: 3901 - protein, 372 aa, Mycobacterium paratuberculosis
MRTRVAELLGVEFPICAFSHCRDVVAAVTNAGGFGILGATAHSPQRLDNELNWIEQQTGGKPYGVDLLLPPKYVGAEQGGIDAGQARTLLPDEHRAFVDDLLARYGVTAPAADIRAGGLNISPKTYQPLLDVAFAHDIRLIASALGPPPPDLVERAHDRDVLVAALAGTTAHAQRHAAAGVDLIVAQGTEAGGHTGEVATMVLVPEVVDAVAPVPVLAAGGIARGRQIAAALALGAEGVWCGSVWLTTEEAETVPVVKEKFLAATSSDTVRSRSMTGKPARMLRTAWTDEWDRPENPDPLGMPLQTALITEPQLRINAAATQPGAKARELATYFVGQVVGSLDRICPTRSVVLDMVEEFIDTVGRLDGLIEN

SEQ ID NO: 3902 - protein, 189 aa, Mycobacterium paratuberculosis
MPTMRLPKLPLDEAKAAADEAAVPNYMAELSIFQVLLNHPPLARAINDLLATMLWHGALDSRLRELVIMRIGWLTGCDYEWTQHWRVASRLGVPGDDLLGVRDWRNYPGFGPTERAVLAATDDVVRHGSVSAASWAQCEHEFNGDTTVLVELVTVIGAWRMVASILQSLEVPLEDGVASWPPDGREPAS

SEQ ID NO: 3903 - protein, 4027 aa, Mycobacterium paratuberculosis
VGGDLGESMARDDRAFPLTRGQLDIWLSQEAGFAGTQWQLGLLVKIDGKVHRDALEQAITQAVAEAEPGRVSFFELDGQVVQKPIDYPHVELAFHDLTDHADPVAEAREMSSAIQRTPMPLNGQMFKFVLFQTGHDEFYLFGCCHHIAIDGLGMALVCRRVATIYSAMVAGKPIPDAYFGTVQDLIDLESGYEASPDYAEDKAYWSEHLPPESGPVDRLPDAEGERDHYSPSASVQLDPSVANRIKELSKKLAIRRFSVTTAACALLVRGWSGSGSEVALDFPVSRRVRPESKTLPAMLAGVVPLVLSTAPESTVADFCKHVDKRIRELLAHQRFPVHTLEGDGLRQAPNRVGINFIPSRLTLDLAGSPATASYTNHGPVGHFGLFFLGAGDQLFLSTAGPGQPFASFGVADLAGRLQQILAAMTEDPDRPLSSIELLTGDEPALIDRWSNRPALTEPAPAPVSIPQAFAEHVQRTPDAVAVTFGATSLTYAQLDEASNRLGHLLADHGVGPGDCVAVMFPRCADAIVSMLAVLKTGAAYVPIDPAHASSRMDFVLADAAPSAVITTSDLRSRLDDHDLLVVDVHDPAVEAQPGTALPWPAPEDTAYIIYTSGTTGTPKGVAIPHLNVTWLIESLDAGLPPGNVWTQCHSSAFDFSVWEIFGALLRGRRLLVVPESVASSPEDFHALLVAEQVSVLTQTPSAVAMLSPEGLESTALVVAGEACPTDVVDRWAAPGRVMLDAYGPTETTVCASISTPLTAGDPVVPIGSPIAGAAMFVLDKWLQPVPAGVVGELYLAGRGVGHGYVRRPGLTASRFVPNPFGAPGSRMYRTGDLVCWGPDGQLQYLGRADEQVKIRGFRIELGETQSVLAGLDGVEQAAVVAREDRPGDKRLVGYITGTADPAELRAQLADRLPPYMVPTAVMVLDALPLTGNGKLDKRALPSPEYAAGEYRAPGDAIEEILADIYAQVLGVERVGVDDSFFDLGGDSILSMQVVARARAAGVICRPRDVFVEQTVARLARVSQVAVDGELGAADEGIGPVQPTPIMRWLQDIDGPIDEFNQTMVLAAPAGVGVDDVAVVLQALLDRHAMLRLCLDDDGAGGWDLHVPPPGSVDARAILRTVDVLSEAALARARSRLNPGAGLMLSAVWASATNELALVVHHLAVDGVSWRTLIEDINIAWAQHHSGQEIALPVPGTSFARWSSILAEYAKSPAVVAAAAAWQQVVATPAVLPAVGPDDTYASEGQLSASLDVQTTRLLLGEVPAAFHAGVQDILLIAFGLACTEFVGGGAPIGIDVEGHGRHEEIASGVDLSRTVGWFTTKYPVALTISQRLDWARVVAGEAALGAVIKDAKEQLRALPDGLSYGLLRYLNPEIEVQGPDPVIGFNYLGRLGGAAADLSDEHWRLSPDSPSVSAAAAAIPLPLGHTVELNAGTMDTDAGPQLHANWTWARSVLTDEQLNRLSRLWFEALTGICAHVQAGGGGLTPSDIAPTLLDQGRIEQLERHYDVADILPLTPLQQGLLFHATGSHAEGDVYAVQLSVTLRGALDPHRLHRALHTVVTRHPNLAARFCPELGEPVQIIPAEPEMAWRYLELDGGDIDEQLEQLSADERAAVRELGDRPPFGAALIRTADTEHRFVLTVHHLVMDGWSLPVLLQEIFACYYGARLPAPAPYRGFVTWLAARDVPAARAAWRAVLDGFDTPTLVAPRGADAPGRRGVASFRVAAETTSAVSELARRRRTTVNTVLQAAWAQLLMMLTGQHDVAFGTAVSGRPAELPGAESMVGLLINTVPVRAHATAATTIADLVDQLQRAHNHTVEHQHLALNEIHRITGQDQLFDTLLVYENYPIDTAALSAADDLTATEFSCHDYNHYPLSLQVVPGDELGLRLEFDTDVFDPAAIDTLADRLRKLLAAMPADPDRPLRSLDLLDATEHTRLQRWGNRPALSRPATGPSLPELFAAQVANAPHAVALRYAGRSMTYRELDEASTRLAHLLAGHGATPGCFVALLFSRSAEAIVAMLAVLKTGAAYLPIDPALPATRIEFMLGDAAPVVAVSTADLRARLEAFGLPVVDVAATGAQPGGPLPAPAPDNIAYLLYTSGTTGVPKGVAVTHRNVAQLLESLHASLPGTGVWSQCHSYGFDVSVQEIWGALAGGGRLVVVPESVTSSPDELHALLIAENVTVLSQTPSALAALSPRNLHAALVIGGEPCPAALADRWAPGRVMINAYGPTETTVDAVLSTPLAAGAGAPPLGSPVAGATLFVLDAWLRQVPAGVTGELYIAGAGVAAGYLGRPGLTAARFVACPFGDAGARMYRTGDLVRWDRDGRLHYVARADQQVKIRGHRIELGEIHSALAELDGVGEVAVIAREDRPGEKRIVGYLTGTADPAAIRARLAERLPAYMVPAAVLAIEALPLTPNGKLDARALPAPEYAGGAYRAPSTPTEEIIAGIYTQVLGLHRVGVDDSFFDLGGDSLSAMRVIAAVNAGLDARLSVRVLFEAPTIAQLAARLGEGGHRFAAVVAAERPAVVPLSFAQSRLWFIGQLHGPSPVYNMVAALRLHGPVDIGALGAALHDVVTRHESLRTVFAATDGTPAQVVLPPDRADIGWQVIDASGWSPARVDDAIRDTARHTFDLAAEIPLRAVLLRCGAEEHLLVAVVHHIAADGWSLTPLVRDLARAYASRSAGRVPDWVPLPVQYVDYTLWQRAQFGDLDDPHSLIAGQLRYWEHTLAGMPERLELPTDRPYPVVADFRGASVAVEWPAQLQQQISRLARAHNATSFMVVQAALAVLLAKVSASSDVAVGFPIAGRRDPALDDVVGFFVNTLVLRVDVSGDPTVGELLARVRQRSLAAYEHQDVPFEVLVERLNPARSLAHHPLVQVMLAWQNIEPTELSLGQVRVTPLPVDTRTARMDLAWSLAERWAPDGSPAGIGGAVEFRTDVFDTATVEALTQRLRRVLAAMTADPGRRLSSIDLLDPDEHARLDALGNRAALTRPQNPPTSIPAMFAAQMARTPHAVALTANGRSVTYRRLEEHANQLAHQLIRYGAGPGDCVALLLERSAEAVAAILGVLKAGAAYLPIDPSLPSARIEFMLTDAAPAAVLTSTEFHCRLQDYHQTVIDVDDPSIREQPVTAPPAPAPDNIAYLIYTSGTTGVPKGVAVTHRNATQLFASLGAAGLPAAPGKVWGQCHSLAFDFSVWEIFGALLNGGRVLVVPDDVVRSPEDLCALLIEERVDVLSQTPSAFDALQRADSARRLNPQTVIFGGEALIPHRLGGWLDGHPARPRLINMYGITETTVHASFREIVDGDIDGNVSPIGMPLAHLGFFVLDGWLRPVPAGVTGELYIAGAGVAAGYLGRPGLTASRFVACPFGGAGERMYRTGDLARWGADGQLQYLGRADEQVKIRGYRIELGEIQSALAELDSVEQAAVIAREDRPGDERLVAYVTGTADPAQLRTALTERLPAYLVPAAVLVLDALPLTPSGKLDTGALPAPDYQGPEDYLAPAGAVEEILAWLYAQVLGLPRRVGVQESFFDLGGDSLSAMRLVAAIYNALDIHLPVRAVFEAPSVRSLSQRLNADPAVAQGLRADFASVHGRDATEVYASDLTLDKFIDAATLSAAPALPGPGAEVRTVLLTGATGFLGRYLVLQWLERLELADGKLICLVRAASDDDARRRLERTFDSGDPALLRYFHELAADHLEVIAGDKGRANLGLDDRTWQRLADTVDLIVDAAAVVNGVLPYQELFGPNVAGTAELIRLALSTRLKPYSYVSTANVGDQIEPSAFTEDADIRVAGPIRTIDGGYGNGYGNSKWAGEVLLREAHDLCGLPVSVFRCDMILADTSYAGQLNLSDMFTRLLFSVVASGVAPRSFYRLDAHGNRQRAHFDALPVEFVAEAIATLGAQVGRDAGIGFATYHVMNPHDDGIGLDEYVDWLIEAGYLIERVDDFDQWLHRMETALHALPERQRHQSVLQLLALRKARHVPPADPARGCLGPTERFRAAVQEAKIGADNDIPHITAPVIVKYVTDLQLLGLL

SEQ ID NO: 3904 - protein, 82 aa, Mycobacterium paratuberculosis
VQLDVRATETARAWIRVKGVQWSNPTYGPGPTTHSRKDRTLADRLAVDVASWALLVDHRLAPYSKVAPARVAGTWAPRLSGF

SEQ ID NO: 3905 - protein, 200 aa, Mycobacterium paratuberculosis
VVEPDVRARPDNAFTEGQDVSRSPRRRRGFLGFARRSSTRPIQQSRPRKGGRNLGTTFVGFLKRLWIPLVIVAVVVAGGLTVSRLHGIFGSEKRPSYADTRQQDTKPFNPKHVKYEVFGPAGAMADISYFDANGEPQHINGVELPWTFDISTTLPSIVGNVVAQGNSDSLGCRILVDGVVKTERISHELNAFTYCVLTAT

SEQ ID NO: 3906 - protein, 963 aa, Mycobacterium paratuberculosis
MSTQQLETQQAARPRVARIIHRLSVPIILGWLAVAVLITIGVPSLEQVEAEHAVSLSPIGAPSFKAMERLGEDFKETNTGALAMILLEGQQQLGDDAHTYYDRLIRLLENDHRHVQHVQNFWGDPLTRGAAQSQDGKAAYVQVNLNGNAGAAAGDESVAAIRKLVQEASPPPGLKVYVTGPAPIVADMNIAGQKTVMLVTLASLIVIFVTLLLVYRSVITVILLLLIVGLELQIARGMVALLGHLGVVGLTTFAVNLLVAAVIATGTDYGIFFVGRYQEARQAGESREEAFYTTFNGVAKVVLASGLTIAGAVLCLSFTRLPYFQPLGIPVAVGISIAVLVALTLGPALLAAGARFGLFEPRRAVSARRWRRIGTAIVRWPAPILIATLAVSLVGLLALPNYRPSYDDQKFIPDSIPANVGFAAAARHFPGQRMQMPEILLVETDHDLRNPTDMLVINKLAKGVLAVPGIATVQTVTRPEGVPLQHTTIPWIISMGQASQMQNMAFQKDRMNDMLVQANELGKMIGIMQHMLDLMRELVATTHHMVKTTHEMQDITSELRDRISDFEDFWRPIRSYFYWEKHCYDIPICFSLRSIFDAIDGVDEINDKLGDLVKNLDQLDALLPQLVMQIPPMIETMSSMRTMMLTMHSTMSGVMGQMDSSAKDPSAMGQAFDASRNDDSFYLPPGIINGSDSFKRVEKVFMSPDGKDVRLLISQRGDPATPEGLSRVEQIKTAAEEALKGTPLENSKIYLTGTAAITKDLVEGSKFDLLIAGVSALCLIFIIMLIMTRSFIAAMVIVGTVLLSLGASFGLSVLVWQYLLHMQLHWTVLSTSVIVLLAVGSDYNLLLVSRMKEELAAGIHTGIIRAMGGTGKVVTNAGLVFAFTMGAMVVSDLRSIGQVGTTIGLGLLFDTLIVRAFMTPSVAALLGRWFWWPQLVRPRPASTMLRPTGPRPLVRSLLLKQPQ

SEQ ID NO: 3907 - protein, 972 aa, Mycobacterium paratuberculosis
MTTERVRPPGAFARVIRRLAVFIILGWVALTLLVTFGVPRLEIVGQQHSVPLAPQDAPAVQAMQRMGRDFKESDSDSFAMLVLEGQQQLGDDAHAYYDKLVRELRNDTKHVEHVQDLWGDRLTQAGAQSPDGKAVYVQLNLAGNQGTTLGQESVAAVRDAIARTPPPPGLNAYVTGPAALFSDMQLAGDRSILKMTLIGALIIFIVLLFVYRSVTTVVLLLLTVGIEVFAARGVIAFVANNNLMPLSTFAVNLLVALAMAAGTDYAIFFFGRYQEARQAGEDRATAYFTTYRSVAPVVLGSGLTIAGAMLCLSFTRMPIFQTMGLPCSVGMLISVFIALTLVPAVLTVGGGFGLFDPKRAIGFGRWRRIGTAIVRWPTPILTATIAVALVGLVTLPGYKTSYNNRLYMPDSVPANVGYAAADRHFTQSRMMPELLMIESDHDMRNPADFLVLHRLAKGVFGVHGISRVQGITRPEGTPIQHTSIPFLLSMQQATMHQDIRYMKARMDDMLVQADLMRKQIEIMRHIYELQKRLTDITHDSIVKTKEMATVLWELRDKMSDFEDFWRPLRSYFYWEKHCYDIPICWSLRNIFETLDGVDTLSDKMTYLLQDLDHMDRLMPQLLEQYPPMIAMSEDMLRMMLTNHSTMSGIIGQMDSNSKDATAMGEAFDASKNDDSFYLPPDIFENADFKKAMSQFLSPDGKAARFIISHRGDPATSEALNRIDKTRSAAEEALKNTPLENAKIYLAGTASTFKDFRDGSTYDLFIAGVGALCLIFIIMLILTRSFIAALVIVGTVTLSLGASFGLSVLIWQYIFGIQLYWMVLPMSVIVLLAVGSDYNLLLVSRMKEEISAGINTGIIRAMGGTGKVVTNAGLVFAFTMASMVVSDLRIIGQVGTTIGLGLMFDTLILRSFMTPTIAALLGRWFWWPQLVRRRPASQLLRSEGTRRSVRVLLHQNDDADADTAEIPVPRPTA

SEQ ID NO: 3908 - protein, 315 aa, Mycobacterium paratuberculosis
VSAPAIEVEGLTKKFGGSTLALAGVDFSVPAGTVCGLLGHNGAGKTTTINILSTLIRPTSGRASVAGHDVVRRPAEVRASIGMAGQFTGLDPMLTGRENLVLFGRLRGLNRRRAKARADELLEQFNLVDAADRRLSTYSGGMFRRVDLASALVVPPKVLFLDEPTTGLDPRSRRDVWALVSSLRVQGITVLLTTQYLEEADVLSDSIVVIDHGRVIASGTSEELKRAVGTSYCQVTPANPADLPQVVATLTGLDGVDIDNDTGSVSVFAPDGVATLVEVFRRVDALGLELADISLRKPSLDEAFLHLTERTVARP

SEQ ID NO: 3909 - protein, 246 aa, Mycobacterium paratuberculosis
MSVLAALTERSLKSAARDGEMIFEIVSPAAYLAGFTVALHGLIDTGRISYSQYLLPAVVVQSMIVVGLLTADRAARDHLFGFGERMRTLPIAAAATVTARVAATLMRALLSLVVAMVAGYAFGFRITGGLGYAMAFLFIALLLCLAVTLGADAVGSRAKSVQGASHLLFVPQLLLFMLSTGLAPEQTFPAWLQPFVRNQPVSQFAETLRGLAAGRVVLSNATAALAWCAGMVLVFGAITLRMQRRG

SEQ ID NO: 3910 - protein, 263 aa, Mycobacterium paratuberculosis
VAHRLQPQGSLLTQSLVQAGRLLLRWRRDQAVLMGSLLLPIFLLFAYQIVLGERVHQVTGIGSVYGIAPMCAVISALFGSLGNSVGITIDRESRVLSRMWVLPIHRASAVTGWVIAEVVRALIGTILITAIALAMGLRFTNGWAAALLFLLIPSITVTGFTALVMAMAVRKKGRTAMTWLLSATFALAFVNPGATPIKLFPDWARPLIRMQPISPPIEAMRSLAHGGPILWPLAITFAWAVVLIAVFIPIAVRGYRLAAEATA

SEQ ID NO: 3911 - protein, 444 aa, Mycobacterium paratuberculosis
VTEANECNSASRKVSVAVEQDTARLLECVHKRLQLAAESGCKGIRSLSNMRRGERPMSLGQVFDPRANALNAWRLVLASGVILWHSFPLTGRMPWAPFVQLLGLGCVDGFFAVSGYLIVSSWLRNPHPAQYFTARCLRILPGLWICLILTAFVIAPIGVGAQGGSAAKLLMSGAPIEYVLKDSAVWMFKFDIGGTPRDIPVAGIWNGSLWTLGWEVLCYIGVAVFGMLGLLSRRWFVPGILILALSWSVFLPAWGGIHAIASNAARFAVMFSAGALLYQFRNVIPARWSFVAVGLIIVVVSSAVLPNYRLVAALPMAYLIIASGSLIHNQRMRFRTDLSYGVYIYAFPIQQVLVLCGFAEINPIAFCAISVAAILPLAALSWFLVEKPALSWKSRLRRKNSSIALANMEDGGSVGRSNDIPGRRARFIGEKAEDPPAPSPRPAL

SEQ ID NO: 3912 - protein, 266 aa, Mycobacterium paratuberculosis
MTAPVFSIIIPTFNAAVTLQACLGSIVGQTYREVEVVLVDGGSTDRTLDIANSFRPELGSRLVVHSGPDDGPYDAMNRGVGVATGEWVLFLGADDTLYEPTTLAQVAAFLGDHAASHLVYGDVVMRSTKSRHAGPFDLDRLLFETNLCHQSIFYRRELFDGIGPYNLRYRVWADWDFNIRCFSNPALITRYMDVVISEYNDMTGFSMRQGTDKEFRKRLPMYFWVAGWETCRRMLAFLKDKENRRLALRTRLIRVKAVSKERSAEP

SEQ ID NO: 3913 - protein, 240 aa, Mycobacterium paratuberculosis
MDFLRNAGLMARNVSTEMLRHFERKRLLVNQFKAYGVNVVIDVGANSGQFGSALRRAGFKSRIVSFEPLSGPFAQLTRKSASDPLWECHQYALGDADETITINVAGNAGASSSVLPMLKSHQDAFPPANYIGTEDVAIHRLDSVASEFLNPTDVTFLKIDVQGFEKQVIAGSKSTLNESCVGMQLELSFIPLYEGDMLIHEALELVYSLGFRLTGLLPGFTDPRNGRMLQADGIFFRGDD

SEQ ID NO: 3914 - protein, 339 aa, Mycobacterium paratuberculosis
VRWHTMDRHADVAWLGQSKLTTTPGPLDRATPVYIAGHRGLVGSALVRRFEAEGFTNLIVRSRDEIDLTDRAATFDFVSETRPQVIIDAAARVGGIMANNTYPADFLSENLRIQTNLLDAAVAVRVPRLLFLGSSCIYPKYAPQPIHESALLTGPLEPTNDAYAIAKIAGILQVQAVRRQYGLAWISAMPTNLYGPGDNFSPSGSHLLPALIRRYEEAKAGGAEEVTNWGTGTPRRELLHVDDLASACLFLLEHFDGPNHVNVGTGVDHSISEIADMVATAVGYIGETRWDPTKPDGTPRKLLDVSALRELGWRPRIALKEGIDATVSWYRTNADAVRR

SEQ ID NO: 3915 - protein, 343 aa, Mycobacterium paratuberculosis
VKRALITGITGQDGSYLAELLLSKGYEVHGLVRRASTFNTSRIDHLYVDPHQPGARLFLHYADLTDGTRLVTLLSSIDPDEVYNLAAQSHVRVSFDEPVHTGDTTGMGSIRLLEAVRLSRVDCRFYQASSSEMFGASPPPQNESTPFYPRSPYGAAKVFSYWTTRNYREAYGLFAVNGILFNHESPRRGETFVTRKITRAVARIRAGVQSEVYMGNLDAIRDWGYAPEYVEGMWRMLQAPEPDDYVLATGRGYTVREFAQAAFDHVGLDWQKHVKFDDRYLRPTEVDSLVGDADRAAQSLGWKASVHTGELARIMVDADIAALECDGTPWIDTPMLPGWGRVS

SEQ ID NO: 3916 - protein, 203 aa, Mycobacterium paratuberculosis
VLDSPWFMHSTDRFSDPDAVASVVEALSGHGPVRDLWGYGKNNLVGLDGKPLFPRPYGYMPFKMRKFLLGATVAHQATFFGASLVAKLGGYDLDFGLEADQLFIYRAALIRPSVTIDRVVCDFDVTGPGSTQPIREHYRTLRRLWDLHGDYPLGGRRVSWAYLRVKEYLIRADLAAFNAVKFLRAKFARASRKQNSSKPTSTA

SEQ ID NO: 3917 - protein, 413 aa, Mycobacterium paratuberculosis
LKGCGSPMRAARTSQPADGPDLPRHPTRLPGDVRPVALFVLGMARSGTSALTRVLSLCGSTLPAGMCGADGNNPRGYWEPRAAIMLNEAILRRHDSNWYDPTLRLQQEAAFGAAERAACIAEITAYLSTLPAAPLVVVKEPRITALPGLWFEAARRVGFDVAAVIAVRHPQEVIASAAKYVSTSPELSSALWLKYNLLAERHTRGVQRVFVDYANLLDDWHREMKRIAGALEIELDTAEEGAIEEFLTADLRRQRHCGPVTDLFGADWMSAVYAALRGAAHDDPLDTATLDRVFESYRASERDFRTAFTDFQARTNSVVRRVFRPSMTMCSIRHGLCTPRIVSPIQMQSLPWWRRSRGMDQYVICGVTGRTTLSDSTANHFSLGRTAICRLRCGNFCSARRLRIRRHSSARRW

SEQ ID NO: 3918 - protein, 398 aa, Mycobacterium paratuberculosis
VRPGDGAGIAPVSADPNVSDPTTIAARGPARRRVPGPTLAQVFDTRINALNVWRLTLASGVILQHSWPLTGRKVHPPYDQLFTQVWVDGFFAISGFLIAASWVRNPRLREYVAARALRILPGLWVCLVVIAFVIAPIAVAIQGGSAAKLLMSRAPIEYVLHNAVLHVFYAGIDGTPRHVPFPGVWDGVLWTLIFEIFCYVAIAVAGVAGLLKRRWPAVVVFILLLVFSALVAYPVEVQTVFQMIGRFALVFAAGTLLHQFQDKIPARWSLVALSAVIVLAAGLLVPNYRVLAAIPLAYAVVVSGALIHHERLRLRTDLSYGVYIYAWPMQQLLAICGLSFLPPVVFAVVAVVVTLPLAALSWFLVEKRALSLKSRIKRRARGWGAVVSGGSRISTPGS

SEQ ID NO: 3919 - protein, 428 aa, Mycobacterium paratuberculosis
VTVDARVDRRAVRVHDDLDAGHRVSGAADSHFGCVVRSFASMFPARRFGGGALAVYVDGQPVVDVWTGWADRAGQRPWSENTAPMVFSATKGMAATVIHRLVDRGLIDYEAPVAEYWPAFAANGKANMTVRQVMRHQAGLSGLRGATKEELLDHLVMEERLAAAAPGRLLGKSAYHALTFGWLMSGLGRAVTGKGMRTLIREELAEPLGTDGLYLGRPPAGAPTRVAEIVAPQNLVGSSIVNYVSRKVANQLSGGFRALYFPGMIAAVQGDTPLLDAEIPAANGVATARGLARMYGAIANGGEVDGIRFLSRDLVAGLTGERSLRPDRNLYVPLAFHLGYHSVPIGGVMPGFGHVGMGGSLGWADPASGVAFSLVHNRLLTPLVMTDHAAFVGIYALIRRAAEQVRKHGFRPVTEFGAPFREPGAVAG

SEQ ID NO: 3920 - protein, 326 aa, Mycobacterium paratuberculosis
MSGRTVTELAAAIRSGDRAALPRAITLLESTRADHQEQAQQLLLELTPDAGDAHRVGITGIPGVGKSTSIEALGMHLIGLGHKVAVLAVDPSSTRTGGSILGDKTRMARLANHPDAYIRPSPTSGTLGGVAKATRETVVLLEATGFDVILIETVGVGQSEVTVANMVDTFVLLTLARGGDQLQGIKKGVLELADIVVVNKADGEHLAEARSAARELSGAIRLIHPRETLWRPPVLTMSAAQGTGLPELWETIERHRQVLSKAGEFEARRRSQLVDWTWQMVRDTVLDRLLSNPAVRTMRADVERRVKAGELTPALAAQEILAAASR

SEQ ID NO: 3921 - protein, 750 aa, Mycobacterium paratuberculosis
MTTTAPAVGSFADVPLRSERPVAPATEAAVEEHVAAIAAAHLYTPDQLHWHTPEDIAVKPVYIGADRAAVEADGYPLHTFPGEPPFVRGPYPTMYVNQPWTIRQYAGFSTAAESNAFYRRNLAAGQKGLSVAFDLATHRGYDSDHPRVQGDVGMAGVAIDSILDMRQLFDGIDLSTVSVSMTMNGAVLPILALYVVAAEEQGVPPEKLAGTIQNDILKEFMVRNTYIYPPKPSMRIISDIFAYTSAKMPKFNSISISGYHIQEAGATADLELAYTLADGVDYIKAGLDAELDIDKFAPRLSFFWGIGMNFFMEVAKLRAGRLLWSELVSQFNPKNPKSLSLRTHSQTSGWSLTAQDAFNNVARTCIEAMAATQGHTQSLHTNALDEALALPTDFSARIARNTQLVLQQESGTTRPIDPWGGSYYVEWLTHHLARKARAHIAEVAEHGGMAQAISDGIPKLRIEEAAARTQARIDSGIQPVIGVNKYQVEEDQEVEVLKVENSRVRAEQLAKLKELRDSRDQSAVDAALAELSRAAAAQGRAGEDGLGNNLLALAINAARAKATVGEISDALEKVYGRHQAEIRTIAGVYRDEAGKATNIATATELVEKFAEADGRRPRILVAKMGQDGHDRGQKVIATAFADIGFDVDVGSLFSTPEEVARQAADNDVHVVGVSSLAAGHLTLVPALRDALKEVGRPDIMIVVGGVIPPGDFDELYAAGAAAIFPPGTVIADAAIGLLHKLAERLGYDLG

SEQ ID NO: 3922 - protein, 625 aa, Mycobacterium paratuberculosis
VSIDVPELADLEQVRGRWRSAVAGVLAKSTRKDPEQLGDAPERLLETPTYDGIAIRALYTALDELPEPPLPGEWPFVRGGDALRDVRSGWKVAEAFPATPVPGVAAKDINSAVLEALGNGAGAVLLRIGESGVAPDQVADSLQGVYLSMAPLILEAGADYPGASDAVLGLANEIEPDQRATVSIDLAGDPLTAGLSGRPAPGLKDVVAVAKRAAGHTGVRAITVDGPAFHNLGANASWELGASIAAGVNYLRVLTESGLTIAAALRQISFRFAADDDQFMTIAKFRAARTVWARVAEVVGEPDAGAAVVHAETSLPMMTQRDPWVNMLRCTLAAFGAGVGGADSLLVFPFDVAIDGGFPGTATSFARRIARNTQLLLLEESHVGRVLDPAAGSWFVEDLTQRLAEQAWQHFQAIEARGGFAEARDFIAGQIAEIAGRRRDDIAHRRTAITGVNEFPNLAEPALPHSDSSYSPLAAGKLIRYATDFEALRDRSDAYLARTGSRPQVLLLPLGPLAENNIRATFASNLLASGGIEAVNPGTVDAAGIAKAVKEAGSPAVAVICGTDKRYQDEASGVVQAARGAGVSRVYLAGPEKAVADAEHRPDQFLTAKINAVEALSDLLTRLGA

SEQ ID NO: 3923 - protein, 258 aa, Mycobacterium paratuberculosis
LEGVTGSATSKIAETLRDLGCAIGAAARGVSRSRIAWTVAGITALVVLASLIPLPSPVQMRDWAQSVGPWFPLAFLLAHIVVTVVPVPRTAFTLAAGLLFGPLLGVAIAVAASTASAMIAMLLVRAAGWRLTRLVRHRSMDTVEERLRQRGWLAIVSLRLIPAVPFSALNYAAGASSVRVLPYGLATLAGLLPGTAAVVILGDALAGHPSSLLYLVSALTSALGLTGLVIEIRHFRRHHRRAHRHRDDEPSPEPATIG

SEQ ID NO: 3924 - protein, 300 aa, Mycobacterium paratuberculosis
VLAVLAVLGFLPGRAERRRKPATGAFPATDVLPPRPRTHTTLLTLAAVCSITALVAAVCLLPRAATPAQQPTPPPVLAPIDLPAASAIGPGAGIYVDYTDGSGGMGCTAGFLVHTSSGQAGILTAGHCNRPGEPSKVTMNLGGVLPYATLGTFSQTISEGVHDEQHDIGLIILDGDNVPQSPAIAASVPVSGVAANLQVGQQLCKFGMGSGADACGQIVEITGSKVKFLAGGQCGDSGGPVYRYENDGTVSAVGILIRGGDPYTRKAGCAARAKFSVAELVRPWLDTWRLTMVTAPSAPR

SEQ ID NO: 3925 - protein, 480 aa, Mycobacterium paratuberculosis
MTPTPSLQRRVTLVVLALLTVLLVVLGVTIDVTMGVLARRNLHDRLLAATSRADALSAAHTAPDLLAAELNGGGIRALVVTADGQAYGDRAISPDLAEGPVEPPPPYPPPLPPPAYPPPYPPPYPPPPGPPPDTTATAVVHPLPDGARLILVADTTQTTQVTRQLRGLMIAAGIVTLLIAALLLIAVSRAALRPLDRLTALANAITTGDRGRRLRPHRADTELGRAASAFDTMLDALEMSERRAQQAAQAAQRAETATRRFLVDAAHELRTPIAGMQVAAEQLAHGASEHPDDGQYRRAGLLLSDARRAGRLVNDMLDLSRIDAGLPLELHDVDVAAVLRDEADRAALLAPQIGVRRTGLTALNVRADATRLSQIVSNLLDNARRYTPPGGAIEIDLRAGDGAAEITVTDTGPGIPDDERERIFDRLVRLDAGRARDHGGAGLGLAIARALARAHGGDLVCLPHRGGARFRLTLPRATTQ

SEQ ID NO: 3926 - protein, 219 aa, Mycobacterium paratuberculosis
VLVVEDSETIREMVSEALTEVGYHTEARRDGERLEELLDGIRPDLVVLDVMLPGRDGFALIDVIRDWGDIGIVLITARDGLPDRLRGLDGGADDYVIKPFELAELVSRVGAVLRRRGRLPQVIQVGDVTLDPGAGVAARGGHRLDLTATELRVLTFLVEQRGRIVSAGQILNGVWGYDAYDPNLVQVHVSGLRRKLEAHGPRILHTVRGIGYRLQPERS

SEQ ID NO: 3927 - protein, 111 aa, Mycobacterium paratuberculosis
MTTNDDINTTTPAPPPAAHQPPERRHSTGVVIGAGVAGALLGAVGTVAAIAFAWIISVGPPGPPPPGPPPMWAAPPMPPPPLHGPPGPPHGFPPPPPGEAFPTLPPPSPRP

SEQ ID NO: 3928 - protein, 156 aa, Mycobacterium paratuberculosis
LLRSRRLMRAPIWIYRARGGAVFGSRILLLEHVGRKSRAPRYAALEVVDHPSPDAYVVASGFGRKAQWFRNIRANPRVRVYAGSHPPRAATARVLDQAEADRALAAYRTRYPRAWQRMRLVLEETLGVPITDTGTPLPMVELRLDQRMHTKKPSTP

SEQ ID NO: 3929 - protein, 97 aa, Mycobacterium paratuberculosis
MDRLEVTSAELRMLSGKWHTNAARLRVATPPPSGMSYQPSAVAVDAAHAAVEVAANSLIGRMIETATKVAAADFSYTANEADSADKMSAIGRQPARQ

SEQ ID NO: 3930 - protein, 259 aa, Mycobacterium paratuberculosis
MRAVPIPRLSELLAWPTDHLTEAADHWMSTRDRWYEAFTETWKDSLSIGWQGNGAEALRSRTYADKVKVSDMVDQLHEAAKVARAGATDLSAARSRMRNAVVDAHEAGFYVHEDLSVTDLSTGNSSADRAIREAEAEAYAADIHQRAADLIRADVRTADRISNAMAGLNGQVPESPSTPTPQPSECADPTELLHDWSELINEINEHNERQYNPYDPAEVAAYEEEYLNLNAKLLKLSSELLDCGIPTSVTPAPAPTPSR

SEQ ID NO: 3931 - protein, 99 aa, Mycobacterium paratuberculosis
VRGIANVVQAVGIYRDADTARAHFDQLLPSLTACTALHAKNYDFTVRQLDTDTLSLSSSVWKLFYRVKSSVLLYVGALGVPQTEQSAQQILQTITNRVT

SEQ ID NO: 3932 - protein, 118 aa, Mycobacterium paratuberculosis
MSALTSPKTYAALGVFHAVDAVACGVQVAPIRKTLDNLGVPDNIRPVLPVVKAAAAVGLLSVTRFPGLARLTTAMLTLYFVLAVGAHVRVRDKVVNGLPAALFVALFAAMTVRGPERS

SEQ ID NO: 3933 - protein, 377 aa, Mycobacterium paratuberculosis
MQGAVAGLVLLAVLVIFAIVVVAKSVALIPQAEAAVIERLGRYSRTVSGQLTLLVPFIDRIRARVDLRERVVSFPPQPVITEDNLTLNIDTVVYFQVTVPQAAVYEISNYIVGVEQLTTTTLRNVVGGMTLEQTLTSRDQINGQLRGVLDEATGRWGLRVARVELRSIDPPPSIQASMEKQMKADREKRAMILTAEGMRESAIKEAEGQKQAQILAAEGAKQAAILAAEADRQSRMLRAQGERAAAYLQAQGQAKAIEKTFAAIKAGRPTPEMLAYQYLQTLPEMARGDANKVWVVPSDFSAALQGFTKLLGTPGQDGVFRFQPSPVEDVPKHSADDDADVADWFSTETDPAIAQAVAKAEAIARQPADGPTGELTQ

SEQ ID NO: 3934 - protein, 147 aa, Mycobacterium paratuberculosis
LPHARRGALANIRAGAGRCGGPHRPSVPGDARRGRAGRGADQLADRFPGVAERAVFLVVSVLLLVVVRPPLRRRLTPAAVPQLGIVALEGKTALVLERVARDRGQVKLDGQVWTARPLDENDVYEPGEPVTVMQIDGATAVVFKSSL

SEQ ID NO: 3935 - protein, 86 aa, Mycobacterium paratuberculosis
LFCPGKADHAYSCRMHAAVLWLIFALVLAGAEALTGHLFLVMLGGGALAAALTSWLTDFPAWLNGRCSWSSRCCCWWWCARRCGAG

SEQ ID NO: 3936 - protein, 322 aa, Mycobacterium paratuberculosis
VIGLPGAKQLHCLLVWCPSVSLSLWANAWLAGKAAPDDVLDALSVWAPKQSVTAYDAVAAGHTGLPWPDVHDAGTVTLLQTLRAAIGVPVGSGLMRGTINVVLPVPGDVRGLAPGTQFEQDALAAGEAVIVSNPHQPGAAVGLVPEFCYADDDDGSEDYALTELCALSWTVYSLPGAPVLDHHELGDAEYTLRSAVRSAAETLGAIGLGSAASDVDDPRGLVEQLLESARQHRIPDHAPSRALRVLENAAHVDAIIAVSAGLSRSDSPDRFAAPIAAGLEPLGTQSSSEARIAGDALRPLTAVVRSARMAAVTAILHSAWGD

SEQ ID NO: 3937 - protein, 336 aa, Mycobacterium paratuberculosis
MDFDAVLLLSFGGPEGPEQVRPFLENVTRGRGVPPERLDHVAEHYLHFGGVSPINGINRALIEQLRAAQDLPVYFGNRNWEPYVEDTVKVMRDNGIRRAAVFTTSAWSGYSSCTQYVEDIARARTAAGTGAPELVKLRPYFDHPLFVEMFAGAIADAAAKVPAGARLVFTAHSVPVAADERLGPRLYSRQVAYAARLVAAAAGYAEHDLVWQSRSGPPQVRWLEPDVADHLRALAESGTRAVIVCPIGFVADHIEVVWDLDEELRAQAESAGMLMARASTPNAQPRFARLAADLIDELRCGRTPARVTGPDPVPGCLASVNGAPCRPPHCAAQATG

SEQ ID NO: 3938 - protein, 209 aa, Mycobacterium paratuberculosis
IELDVQNEEHLNTLAQRVTAEIGEGNRLDGVVHSIGFMPQTGMGINPFFDAPYEDVSKGIHISAYSYASLAKALLPIMNPGGSIVGMDFDPSRAMPAYNWMTVAKSALESVNRFVAREAGPHGVRSNLVAAGPIRTLAMAGIVGGVLGDQAAEQIRLLEEGWDQRAPIGWNMKDPTPVAKTVCALLSDWLPATTGTIIYADGGASTQLL

SEQ ID NO: 3939 - protein, 255 aa, Mycobacterium paratuberculosis
VTDTATENTTESAADYGRPAFVSRSVLVTGGNRGIGLAIAQRLAADGHKVAVTHRGSGAPDGLFGVECDVTDNDAVDRAFTEVEEHQGPVEVLVSNAGISKDAFLIRMTEERFTEVINANLTGAFRVTQRAARSMQKKRFGRIIYIGSVSGMWGIGNQSNYAAAKAGLIGMARSISRELSKAGVTANVVAPGYIDTEMTRALDERIQAGALEFIPAKRVGTAAEVAGAVSFLASEDASYIAGAVIPVDGGMGMGH

SEQ ID NO: 3940 - protein, 275 aa, Mycobacterium paratuberculosis
MLVAVILRGDLDLFPSHVQIRLGPTPFVADRDLRLRPREPGVDQQHPQPALFGRLGAAVDQCQRRSGRLDVMPTAVAVHEQLDVRHLQLRRLHQGVGGGDRHAPGMAARQVKRGARRCGDRHAGDDGDLVGLDALLPNPHPAGVTAIGVDDLGRPRRVDPLRTVQRGGRETRQHAAPARPQPCRLRPHHRRQLGVASDMPSRCSATYRLRNSWRDSNRAPRASLPRKGSVMAKVCCATPTPWRARNATAQTRPDFRPGVTSGASRFPGRSAEAIG

SEQ ID NO: 3941 - protein, 335 aa, Mycobacterium paratuberculosis
MSLPFLGPMSLSGFEHSWFFLFLLVVAGLAALYILMQLARQRRMLRFANMELLESVAPKRPSTWRHLPAILLVASLVLFTIAMAGPTNDVRIPRNRAVVMLVIDVSQSMRATDVAPNRMAAAQEAAKQFADELTPGINLGLIAYAGTATVLVSPTTNREATKNALDKLQFADRTATGEGIFTALQAIATVGAVIGGGDKPPPARIVLFSDGKETMPTNPDNPKGAFTAARTAKDQGVPISTISFGTPYGFVEINDQRQPVPVDDETLKKVAQLSGGNAYNAASLQELKSVYATLQQQIGYETIKGDASVGWVRLGALVLALAALTALLINRRLPT

SEQ ID NO: 3942 - protein, 316 aa, Mycobacterium paratuberculosis
VTDPKRPVLHPPSMQRGQIDDPKLSAALRTLELTVKRKLDGVLHGDHLGLIPGPGSEPGESREYQPGADVRRMDWAVTARTTHPHVRQMIADRELETWLVVDMSASLDFGTTVCEKRDLAVAAAAAITFLNSGGGNRLGALIANGATMTRVPARSGRQHEQTLLRTIATTPRAPVGVRGDLATAIDALRRPERRRGMAVIISDFLGPINWQRPLRAIAARHEVLAIEVLDPRDVELPDIGDVVLQDAETGVTREFTIDAQLRDDFAKAAAAHRADVARTIRSCGAPILTLRTDRDWIADIVRFVESRRRGALAGRQ

SEQ ID NO: 3943 - protein, 380 aa, Mycobacterium paratuberculosis
MTAAGGPPPGAGGYSGPGGQSGPGAHEAPTGGAGAGNGLAAEVQTLERAIFEVKRIIVGQDQLVERMLVGLLSKGHVLLEGVPGVAKTLAVETFAKVVGGTFARIQFTPDLVPTDIIGTRIYRQGKEEFDTELGPVVVNFLLADEINRAPAKVQSALLEVMQERHVSIGGKTFPLPNPFLVMATQNPIEHEGVYPLPEAQRDRFLFKINVGYPSPEEEREIIYRMGVRPPEPKQILNTGDLVRLQDIAANVFVHHALVDYVVRVVTATRHPEQLGMNDVKTWISFGASPRASLGIIAGARSLALVRGRDYVIPQDVVDVIPDVLRHRLVLTYDALADEISPEIVINRVLQTVALPQVNAVPQQGHSVPPVMQPAGAASGR

SEQ ID NO: 3944 - protein, 244 aa, Mycobacterium paratuberculosis
MRRNRFRLIVFAWITAMVTGLMFSVAPTPAALADPGEWDPTLPAQISAGAPGDPLAVANASLQATAQATQTTLNLGKQFLGGLGINLGGNDAPAAAATPSNPGGKIPRVYGRQAIEYVIKRMGSQMGVPYSWGGGSLDGPSKGVGDGANITGFDCSGLMRYGFAGVGVLIPRFSGDQYNAGRHIPQDQARRGDLIFYGPGGSQHVTMYLGNGQMLEASGSAGKVTVSPVRKPGMTPFLTRIIEY

SEQ ID NO: 3945 - protein, 470 aa, Mycobacterium paratuberculosis
MRRTRWGTSARPAARLVRPVVPSVLSVALLICTPGLAQADPVADNLAALIANVAKANQRLQNLSAEIQTEQESVNKALVDVETARDNAAAAQHDLEASQQAVKDANAAIAGAQRRFDTFAAAAYMNGPSNSYLTARNPDDIIATEAAAKTLTASSQTVMAKLQQARTEQVNRESAARLAKQNADKAAADAKASQDAAVAALTNSRQKFDEQREQMIRLATERDQAQAKLEAAKRQLSTAGSGDRWETGSAGAPAPSAGRQWDGAWDPTLPMIPSANVPGDPIAVINQVLGISATSTQVTAGLGRNFLQQLGILKPDDTGITNAAPGGVGARIPRVYGRQATEYVIRRGMSQIGVPYSWGGGNAAGPSKGIDSGANIVGFDCSGLVLYSFAGVGIKLPHYSGSQYNLGRKIPSSQMRRGDVIFYGPGGSQHVTIYLGDGQMLEAPDIGLKVRVAPVRTSGMTPYVVRYIEW

SEQ ID NO: 3946 - protein, 208 aa, Mycobacterium paratuberculosis
MPAERHTRVTAGAERHASVTAAAGGTTMTAHDSAPPLYIPVDVDMTMVKAAVAATGVSAPPAAMPGLLEVVNQARAEGINLKIVLLDHNPPNDTPLRDISTVVGADYHDATVLTLSPNYVGSYSTQFPRVTLEAGEDIAKTGNPVVSAQHFLHELDTPEFPWTGLTIFLLIAVFAAAVGTRVLQVRSRRAATPPDAAGADTVTPTNTA

SEQ ID NO: 3947 - protein, 959 aa, Mycobacterium paratuberculosis
LLKLAPSPTRPVGGRTKSLGVEVTDSVNSFGARNTLKVGDKSYQIYRLDAVPNTEKLPYSLKVLAENLLRNEDGSNITKDHIEAIANWDPKAEPSIEIQYTPARVVMQDFTGVPCIVDLATMREAIADLGGNPEKVNPLAPADLVIDHSVIADLFGTADTFERNVEIEYQRNGERYQFLRWGQGAFSDFKVVPPGTGIVHQVNIEYLARVVMERDGVAYPDTCVGTDSHTTMVNGLGVLGWGVGGIEAEAAMLGQPVSMLIPRVVGFKLTGEIQPGVTATDVVLTVTEMLRKHGVVGKFVEFYGEGVAEVPLANRATLGNMSPEFGSTAAIFPIDEETIDYLKFTGRNAEQVALVETYAKEQGLWHDPAHEPAFSEYLELDLSQVVPSIAGPKRPQDRIALSQAKSVFREQIPSYVGDGDGQQGYSKLDEVVDETFPASDPGAPSNGHADDLPAVQSAAAHANGRPSNPVTVRSDELGEFVLDHGAVVIAAVTSCTNTSNPEVMLGAALLARNAVEKGLASKPWVKTTMAPGSQVVHDYYDKAGLWPYLEKLGFYLVGYGCTTCIGNSGPLPEEISKAINDNDLSVTAVLSGNRNFEGRINPDVKMNYLASPPLVVAYALAGTMDFDFEKQPLGKDKDGNDVYLKDIWPSQKDVSDTIASAINSEMFTKNYADVFKGDERWRNLPTPSGNTFEWSPDSTYVRKPPYFEGMPAEPEPVADISGARVLALLGDSVTTDHISPAGSIKPGTPAAQYLDEHGVDRKDYNSFGSRRGNHEVMIRGTFANIRLRNLLLDDVAGGYTRDFTQDGGPQAFIYDAAQNYAAQNIPLVVLGGKEYGSGSSRDWAAKGTRLLGVRAVIAESFERIHRSNLIGMGVIPLQFPDGKSAKDLGLDGTEVFDITGIEELNKGKTPKTVHVKASKNGSDAVEFDAVVRIDTPGEADYYRNGGILQYVLRNMLKSG

SEQ ID NO: 3948 - protein, 192 aa, Mycobacterium paratuberculosis
MPKVSEDHLAARRRQILDGARRCFAEFGYDKATVRRLEQAIGMSRGAIFHHFRDKDALFFALAHEDAERMAEVASRAGLIQVMRDMLAAPDQFDWLATRLEIARKLRNDPAFSRGWAERSAELAAATTDRLRRQTEAHRVRDDVPGDVLQCYLELVLDGLVARLASGEDPQRLSAVLDLVENSVRRNDSRPG

SEQ ID NO: 3949 - protein, 77 aa, Mycobacterium paratuberculosis
MCPGVGGAMRRTVQRSANSRDQLLDELRHAYESGASIRSLVARTGRSYGSIHSMLRESGTTMRSRGGPNRTAKAARA

SEQ ID NO: 3950 - protein, 545 aa, Mycobacterium paratuberculosis
VITATDLEVRAGARILLSPDGPDLRVQPGDRIGLVGRNGAGKTTTLRILAGETEPYTGTIARSGEIGYLPQDPKEGDLDVLARDRVLSARGLDVLLTDLEKQQALMAEVADDDARDRAIRRYGQLEERFVALGGYGAESEASRICASLGLPERVLTQQLRTLSGGQRRRVELARILFAAAEGGATGSGSATTLLLDEPTNHLDADSIGWLRDFLRAHTGGLVIISHNVELLADVVNRVWFLDAVRGEVDVYNMSWQKYLDARATDEQRRRRERANAERKAAALRTQAAKLGAKATKAVAAQNMLRRADRMMAALDEERVADKVARIKFPTPAACGRTPLTATGLSKSYGSLEVFSGVDLAIDRGSRVVVLGLNGAGKTTLLRLLAGAETPDTGRIEPGHGLRIGYFAQEHDTLDNDATVWQNIRHAAPDSGEQDLRGLLGAFMFSGPQLDQPAGTLSGGEKTRLALAGLVASTANVLLLDEPTNNLDPASREQVLDALRSYTGAVVLVTHDPGAAEALDPQRVVLLPDGTEDYWSDEYRDLIELA

SEQ ID NO: 3951 - protein, 269 aa, Mycobacterium paratuberculosis
VSLVLVDHPRPGVALITLNRPERMNSMAFDVMVPLKEALQKVTYDNAVRVVVLTGAGRGFSSGADHKSAGTVPHVEGLTRPSYALRSMEILDEVILALRRLHQPVIAAVNGPAIGGGLCLALAADIRVASTSAYFRAAGINNGLTASELGLSYLLPRAIGSSRAFEIMLTGRDVTAEEAERIGLVSCQVPEEQLLDTCYAIAARIAAFSRPGIELTKRTLWSGLDAGSLEGHMQAEGLGQLFVRLLTANFEEAVAARAERRPPVFTDDK

SEQ ID NO: 3952 - protein, 117 aa, Mycobacterium paratuberculosis
VTTVDLTAEKFNETIEGNDIVLVDFWASWCGPCRQFGPTFQASSEKHPDIVHAKVDTEAEQQLAAAAQIRSIPTLMAFKKGKLLFNQPGALPPAALEDLVQQVRAFDVDAAIAEQGE

SEQ ID NO: 3953 - protein, 609 aa, Mycobacterium paratuberculosis
LGHYIANVRDLEFNLFEVLDVGAVLGSGGYGDLDEETVRTILAEAARLAEGPVAETFAFADRNPPVFDPAEHAITVPEELAKTVAALKEAGWWRLGMAEEIGGMPAPPPLAWAVNEMLICANPSANFFCLGPFMSQALYLEGNEQQRRWAAEGVERGWAATMVLTEPDAGSDVGAGRAKAIEQPDGTWHIEGVKRFISGGDVGDTAENIFHLVLARPEGAGPGTKGLSLFYVPKYLFDPKTFELGPRNGVFVTGVEHKMGIKSSPTCELTFGATDVPAVGYLVGDVHRGIAQMFTVIEQARMTIGVKAAGTLSTGYLNALAFAKERVQGADLTQMADKTAPRVTIIHHPDVRRSLMTQKAYAEGLRALYMYAAAHQDDQVAQRVSGADHDMAHRVDDLLLPIVKGVSSERAYEVLTESLQTLGGSGFLQDYPLEQYIRDSKIDSLYEGTTAIQALDFFFRKIVRDRGQALQFVTAQITATVDDCDEALRPIAELLQTAFDDVTAMTGALTGYLMSAAEQPTDIYKVGLASVRYLLAVGDLLIGWRLLVHADVAQRALAAGAGGDDEAFYRGKIATAAFFAKNMLPRLSGLRGIIEAIDDEIMKLPEAAF

SEQ ID NO: 3954 - protein, 258 aa, Mycobacterium paratuberculosis
MSASCHGLARVAVFAVAGATAVSLSACGTSNKSSPTSTSTSTSTVTSTSTSAAPNAEAKVSGLIASVAGNSIQVTKEDNGTAAVNFTSTTKITEAVPAGLPDVTPGSCVSVKPTEGSAPGQPVTAASVKISQSVNGACPKPHQPTPGGSSSPAPSLPPSQAPAKPALVTGSVASVSGNTINVTGTDPSGNTTQTTVTVDDKTKYTKQSSANTDAITPGKCLSARGTNDSGGALQATSIQLRQAVDGKCGKPKQPGHGG

SEQ ID NO: 3955 - protein, 244 aa, Mycobacterium paratuberculosis
VPALSLKPRRTQIAIGAVIALIVFGVAMCGPSHDSSSSSAPPAVTAVPPPAPSAAPPASPAPPPAGRDYVEGMVQSNSGGTIALRTRTGSATVDYTPQTRVVQVGPAKLADVTPGSCVNVRATPQSAPPPGAITAQSVTVTPAADGKCPPPAGFFGTVASVDGNTIAVTGLGPGGPTNVTVADSTSYQKQTPSDAQAITNGKCLGANGTQDGGVLHATMISLETCPPMGHPHHHLHLPHLPLHL

SEQ ID NO: 3956 - protein, 115 aa, Mycobacterium paratuberculosis
MSETTAPDDELLADVEEAMRDVVDPELGINVVDLGLVYGLNVEEGDEGTVALIDMTLTSAACPLTDVIEDQSRSALVGAGLVDDLRINWVWNPPWGPDKITDEGREQLRALGFTV

SEQ ID NO: 3957 - protein, 159 aa, Mycobacterium paratuberculosis
VRLEQMYQDVILDHYKHPQHRGLREPFGAEVFHVNPVCGDEVTLRVTLSDDGETVADVSYDGQGCSISQAATSVLTEQVIGRSVEEALDTIGAFAEMVSSRGAVEGDEDVLGDGIAFAGVAKYPARVKCALLGWMACKDALAQAYSRREVTDERNHRAG

SEQ ID NO: 3958 - protein, 415 aa, Mycobacterium paratuberculosis
MTATQLDVAAIRADFPILKRIMRSGNQLAYLDSGATSQRPLQVLDAEREFLLTSNGAVHRGAHQLMEESTDAYEQGRADIAAFVGADPDELVFTKNATEALNLVSYVVGDNRFEGAVGPGDVIVTTELEHHANLVPWQELARRTGASLRWYGVTDDGRIDLDSLQLDERVKVVAFSHHSNVTGAVAPVAELVGRARAVGALTVLDACQSVPHQPVDFHALDVDFAAFSGHKMLGPNGIGVLYGRREVLSQLPPFLTGGSMIETVTMESSSYAQVPQRFEAGTPMTSQVVGLAAAARYLGAFGMDAVQAHEERLVAAAIEGLSGIDAVRIVGPTSTENRGSPVSFVVDGVHAHDVGQVLDDEGVAVRVGHHCALPLHRRFGLAATARASFAVYNTAEEVDRLVAGVRRALDFFGGV

SEQ ID NO: 3959 - protein, 260 aa, Mycobacterium paratuberculosis
MTTLEIKDLHVSVVNPNAAESEREIPILNGVDLTVKSGETHALMGPNGSGKSTLSYAIAGHPKYTVTSGSITLDGQDVLAMSIDERARAGIFLAMQYPVEVPGVSVSNFLRSAATAVRGEAPKLRHWVKEVKAAMGALEIDPAFAERNVNEGFSGGEKKRHEILQLELLKPKIAILDETDSGLDVDALRVVSEGVNRYAQAEHGGILLITHYTRILRYIHPEYVHVFVGGRIAESGGSELADELEQNGYVRFTQAAAAGA

SEQ ID NO: 3960 - protein, 396 aa, Mycobacterium paratuberculosis
VTNLTEAVEGSSLAAANKGELFASFDVDAFEVPHGRDEIWRFTPLRRLRGLHDGSAPATGKAEVSVGEQPGLRVQTVRRGDERLGQGGIPTDRVAAQAFSSFNSATLITVPRDTQIAEPIGVTVTGPGEGAVAYGHLQIRVEELAEAVVVIDHRGSGTLADNVEFVVDDAARLTVVWLADWADDAVHVSMHHARLGKDAVLRHVAVTLGGELVRLTANVRYTSTGGDAELLGLYFADDGQHLESRLLVDHAQPDCKSNVLYKGALQGDPASALPDAHTVWVGDVLIRAEATGTDTFEVNRNLVLTDGARADSVPNLEIETGEIAGAGHASATGRFDDEQLFYLRSRGIPEEQARRLVIRGFFAEIISKIAVPEIRERLTAAIEHELAFTESRATAS

SEQ ID NO: 3961 - protein, 482 aa, Mycobacterium paratuberculosis
MTLTPEASKTAVAPLTQEEAIASLGRYGYGWADSDVAGASAQRGLSEAVVRDISAKKNEPEWMLQTRLKALRIFERKPMPTWGSNLDGIDFDNIKYFVRSTEKQAASWEDLPEDIRNTYDRLGIPEAEKQRLVAGVAAQYESEVVYHQIREDLEAQGVIFMDTDTGLREHPEIFQEYFGTVIPAGDNKFSALNTAVWSGGSFIYVPPGVHVDIPLQAYFRINTENMGQFERTLIIADEGSYVHYVEGCTAPIYKSDSLHSAVVEIIVKPNARVRYTTIQNWSGNVYNLVTKRARAEAGATMEWIDGNIGSKVTMKYPAVWMTGEHAKGEVLSVAFAGEDQHQDTGAKMLHLAPNTSSNIVSKSVARGGGRTSYRGLVQVNKGAHGSCSSVKCDALLVDTISRSDTYPYVDIREDDVTMGHEATVSKVSENQLFYLMSRGLTEDEAMAMVVRGFVEPIAKELPMEYALELNRLIELQMEGAVG

SEQ ID NO: 3962 - protein, 281 aa, Mycobacterium paratuberculosis
VQPIRCDQGNRPPRAPLLDRSPELRHTGVVKIRTSLDDAAVGAAGAAVPDGHTRRAIVRLLLESGSITAGEIGDRLGLAAAGVRRHLDALIEAGDAESIAPAAWQHAGRGRPAKRYRLTSAGRAKLDHAYDDLAAAAMRQLREIGGEEAVQAFARQRIDAILAGVPGAASAADDDIEAAAERIATALTKAGYVATTTQVGGPIHGVQICQHHCPVSHVAEEFPELCDAEQQAMAEVLGTHVQRLATIVNGDCACTTHVPLAQTAKAPSPRRHTTSNKGASL

SEQ ID NO: 3963 - protein, 567 aa, Mycobacterium paratuberculosis
MAARHHTLSSSIASLHGDEQAVGSPLNDTELTALRCTRLFGASGTMLMAIGALGAGARPVVQDPTFGVRLLNLPSRIQTVSLTMTTTGAVMMALAWLMLGRFALGTRRMSRGDLDRTLLLWVLPLLIAPPMYSKDVYSYLAQSQISLEGLDPYRVGPASGLGLSHIFTLSVPTLWRETPAPYGPLFLWIGRGISAITGENIVAAVLCHRLVELIGVGLIVWATPRLARRCGVAEVSALWLGAANPLLIMHLVAGVHNEALMLGLMLAGAEFALRGIDSARLLPHSLRPGPDWEPLGMLLAGAVLITLSSQVKLPSLLALGFVTMALAYRCGGNLRALLLAGGGMAALSLAVMALVGWASGLGFGWIYTLGTANVVRSWMSPPTLLALGTGQVGILLGLGDHTTAVLGLTRAIGVLIITVMVGWLLLAVFRGRLHPIGGLGVALGVTVLLFPVVQPWYLLWAIIPLAAWATRTGFRVAAIVISLVVGIFGPTANGDRFALFQIVDATLASTVIVAVLIALTYTRLPWRPLPAPQRAPDGEPVIDPVAPARSPSTPRPAPAHDAYADST

SEQ ID NO: 3964 - protein, 311 aa, Mycobacterium paratuberculosis
VSADVPETVVRLRGVSKHYGSTTAVRDLDLEVHAAEVLALLGPNGAGKTTTVEMCEGFVRPDAGTLEVLGLDPIADNARLRPRIGVMLQGGGGYPAARAGEMLNLVAAYAADPLDPAWLLDTLGLTDAARTTYRRLSGGQQQRLALACALVGRPELVFLDEPTAGMDAHARLLVWELIDALRRDGVTVVLTTHQLKEAEELADRLVIIDHGATVAAGTPAELMRSGAKDQLRFSAPPRLDLSLLSAALPEDYKATELTPGEYLVEGPVDPQVLATVTAWCARIDVLATDMRVEQRSLEDVFLDLTGRKLRQ

SEQ ID NO: 3965 - protein, 259 aa, Mycobacterium paratuberculosis
VTDSGVFPVGTFTPNPRPSAVPKMLAAQYGLELKLLLRNGEQLLLTMFIPITLLVGLTLLPLGSFGQHRAATFTPVIMALAVISTTFTGQAIAVAFDRRYGALKRLGATPLPVWGIIAGKSLAVVTVVFLQAILLGAIGFALGWRPALAALALGAAVIALGTAVFAALGLLLGGTLRAEIVLALANLMWFVFAGLGALTVDSGVIPAGVKWAARLTPSGALTEALSRAMTLSADWFGMAVLVAWGALGALGALRWFRFT

SEQ ID NO: 3966 - protein, 311 aa, Mycobacterium paratuberculosis
LRLVDLLPNPSVGVQRLIAVAVILTQGGIAITGAIVRVTASGLGCPTWPQCFPGSFVPVPHAEVPRIHQAVEFGNRMITFAVVVAAALAVLAVTRARRRPEVLVYAWLMPVSTVVQAVIGGITVRTGLLWWTVAIHLLTSMTMVWLSVLLYVKIGEPDDGVDQPRVPTPLRVLTALSGVNLAAVLVTGTLVTAAGPHAGDRSPTRTVPRLKVQVDTLVHLHSSLLVAYLALIVGLGFGLLAVRAARPILLRLGVLLVLLCAQAAVGTAQYYTGVPAALVAVHVAGAAACTAATAALWASMRQRAQAEPLTG

SEQ ID NO: 3967 - protein, 219 aa, Mycobacterium paratuberculosis
MCLSCPGMKLARPDVFHPRIVLAGRRDDPGLVSALRRRGLHARRLPWEDPETLQADLVIVRVGPDAARRDEFLAWTRRPRHLLNPPAALAWNLDAHYLRDLRDGGVPTRPGAQPDTSLIFLGGAQSHAWPAEPEFESWDLGHAALAVAADHTGIGVPELLFARADLAGDRLVRLDLVAPELGWRHLDTPGREAAQRRFALAVESACERLGLGPLSHRRP

SEQ ID NO: 3968 - protein, 331 aa, Mycobacterium paratuberculosis
MPGHDKHMHAIEVSETGGPEVLRYVETPTPTAGPGQVLIKAEAIGVNYIDTYFRSGQYPRELPFIIGQELCGTVAAAGDGVDGFNVGDRVVSAAATGGYAEYATAPASLTAHVPDGVAADVAASALLKGLTAHYLLKSVYPVQAGDTVLVHAGAGGVGLILTQWAHLLGARVITTVSTPEKARRSAQAGADEVLSYPDDADEFGSRIRALTDGAGVAAVYDGVGASTFDASLASLAVRGTLALFGAASGPVPPFDPQRLNAAGSVFLTRPSLAHFIRTGQEFSWRAEELFAAIAAGDITVEVGGRYPLADAARAHRDLQGRKTTGSIVLLP

SEQ ID NO: 3969 - protein, 308 aa, Mycobacterium paratuberculosis
VSVRGRVAPSQTPSRIPGTVLAYLALTKPRVIELLLVTAIPAMLLAQRGTVNPLLIVNTLIGGMLAAGGANALNCVADADIDKVMKRTARRPLARAAVPTRNALVFGLVLTAGSFLWLWWTTNLLSGLLALATIAFYVFIYTLLLKRRTSQNVVWGGAAGCMPVMIGWSAVTGTIQWPALVMFAIIFFWTPPHTWALAMRYKDDYKAAGVPMLPAVATERQVTKQIVVYTWLTVLATLALALATGWLYAAVALVAGVWFLAMAHQLYAGVRAGEPVKPLRLFLQSNNYLAVVFCALAIDSAIGLPHLF

SEQ ID NO: 3970 - protein, 699 aa, Mycobacterium paratuberculosis
VTTLEEISALTQPHLPDDWSELDSAAVDTIRVLAADAVQKVGNGHPGTAMSLAPLAYTLFQRVMRHDPSDTHWLGRDRFVLSAGHSSLTLYLQLYLGGFGLELSDIESLRTWGSKTPGHPEFRHTKGVEITTGPLGQGLASAVGMAMASRYERGLFDPDAAAGTSPFDHFIYVIASDGDIEEGVTSEASSLAAVQQLGNLIVFYDHNQISIEDDTNIALCEDTAARYEAYGWHVQRVEGGENVVAIEEAIAAAKAVTDRPSFIELRTIIGYPAPNAMNTGKAHGAALGEEEVAAVKKILGFDPDKTFQVRDEVIAHTRKLVDRGREAHQKWQTDFDAWAQREPERKALLERLTAEKLPDGWDADLPHWEAGSDAIATRKASGAVLNAVAPKLPELWGGSADLAESNLTTINNADSFGPPSISTKEFTASWYGRVLHFGVREHAMGAILSGIVLHGPTRAYGGTFLQFSDYMRPAVRLASLMDIDTIYVWTHDSIGLGEDGPTHQPIEHLAALRAIPKLSVVRPADANETAYAWRTILARGNGSGPVGLVLTRQGLPVLEGTDADGVARGGYILGSDGEEAGQEPDVILIATGSEVQLAVEAQKLLADKDIVARVVSMPCVEWFESQPDDYRDSVLPPSVSARVAVEAGVAQSWHKLVGDTGKIISIEHYGESADYKTLFREFGFTAEAVAAAAEEVVDN

SEQ ID NO: 3971 - protein, 373 aa, Mycobacterium paratuberculosis
MTAQNPNLAALSAAGVSVWLDDLSRDRLRSGNLQELIDTKCVVGVTTNPSIFQKAFAEGHAYDSQIAELAARGADVDATIRTVTTDDVRNACDVLTREWENSDGVDGRVSIEVDPRLAGDTDKTIAQAVELWKIVDRPNLFIKIPATQAGLPAITAVLAEGISVNVTLIFSVERYRAVMDAYLAGMEKAREAGHDLSKIHSVASFFVSRVDTEIDKRLEKIGGERALALRGQAGVANARLAYAAYQEVFEGGQRYQALKADGARVQRPLWASTGVKNPDYSDTLYVTELVAPNTVNTMPEKTIDAVADHGVIRGDTVTGTGPDAQRVFDELAAVGVDLPDVFVVLENEGVEKFVDSWTELMEETQKQLGSASK

SEQ ID NO: 3972 - protein, 514 aa, Mycobacterium paratuberculosis
MSPARTAQQWHNPLRDKRDKRLPRIAGPCGMVIFGVTGDLARKKVMPAIYDLANRGLLPPSFSLVGFARRDWSTQDFGKVVYEAVKEHCRTPFRQENWDRLAEGFRFVPGAFDDDEAFGRLAETLDKLDAERGTGGNHAFYLAIPPKSFPVVCEQLHKSGLARPQGDRWSRVVIEKPFGHDLESAQSLNKAVNAVFPEESVFRIDHYLGKETVRNILALRFANQLFDPIWNSHYVDHVQITMAEDIGLGGRAGYYDGIGAARDVIQNHLMQLLALTAMEEPVSFSPLALQAEKIKVLSATHLAHPLDETTSRGQYTAGWQGGEKVVGLLDEEGFAKDSITETFAAITLEVDTRRWAGVPFYLRTGKRLGRRVTEIALVFKRAPHLPFDATMTDELGANAMVIRVQPDEGVTLRFGSKVPGTAMEVRDVNMDFSYGSAFAEESPEAYEQLILDVLLGEPSLFPVNAEVELAWHILDPVLDNWASGGRPEPYEAGTWGPDSAFEMLHRTGREWRRP

SEQ ID NO: 3973 - protein, 303 aa, Mycobacterium paratuberculosis
LIIDMPDATTTAVNKKLDELRERVGAVAMGRALTLIIAPDSEEILEESLKAANDASHEHPSRIIVTLRGNPYADKPRLDAQLRAGGDTGASEVVVLWLSGALSGHAASVVTPFLLPDIPVVVWWPDVAPAVPAQDPLGRLAIRRITDATNGVDPLAAIKSRLPGYTAGDTDLAWARITYWRALLAAAVDLAPHEPIESALVSGLKTEPALDVLAGWLASRIDGPVRRAVGELKVELARSSETIVLSRPQEGRTATLSRTSRPDALLPLARRETGECLAEDLRRLDADEIYQSALEGIEKVQYV

SEQ ID NO: 3974 - protein, 251 aa, Mycobacterium paratuberculosis
VSTRIEIFPDSQALVTAAAARLADTIADAVAARGRALIVLTGGGNGIGLLKSLAGRPIDWSAVHLFWGDERYVPEDDDERNEKQAREALLSHVDIPSSQVHPMPASDGEFGSDLAAAALAYEQLLAANAAPGQPVPNFDVHLLGMGPEGHINSLFPDTPAVLETTRMVVPVEDSPKPPPQRITLTLPAIARSREVWLMVSGAGKADAVAAAINGAAPVSVPAAGAVGLDTTLWLLDREAAAKLPPGTAVQG

SEQ ID NO: 3975 - protein, 132 aa, Mycobacterium paratuberculosis
MTGMADRTVRGGQERSRIKTLTQAALNADKTVEQVEDVLDGLSSTLKELSSSLAALNATVERMETGLDHLDGTLASLDDLAKRLIVLVEPVEAIVARVDDLVKVGETVMSPLSVTEHAVRGLVDRLRNRTAQ

SEQ ID NO: 3976 - protein, 309 aa, Mycobacterium paratuberculosis
MATLLLHHPDFAAHRTAPGHPERPDRYRAVAAALSRPGFDALVRETAEPAELAATRYVHSNRYVDAPEAARPQHGYVYLDGGDTMMEPSTWETALRGVGATLQAVDRVLAGDVQNAFVACRPPGHHAETERAMGFCLFNNISIGARHAQRKHGLMRVAIVDFDVHHGNGTQQIFYSDPSVLYASTHQMPLFPGTGAAAETGVGNIFNSPLAPGDGGAELRAAFTDRFVPALQAFSPELIIVSAGFNAHERDPLGSLTMTTDDFGWVTRELMKSAEKLCDGRLVAVLEGGYDLQALADSVTAHVGELLKG

SEQ ID NO: 3977 - protein, 328 aa, Mycobacterium paratuberculosis
LKTITFGKTGLEVSRLAFGTWEFCSDWGHADEDAAITMIRSARDLGINFFDTAQQYGFGASERLLGKALRDDLARARDEVVIATKGGLRATDGGLVRDASPQWLRKGVESSLTALGIDHIDVYLVHWPDPRMPAAETAGALAELVSEGKIRHVGVSNYDTAQVEEFSATLPVEVVQPPYHLFRRDIEETLLPYAREHDIGVMVYGPLAHGLLTGTVKPDTRFAPQDWRAKSDIFSGDGFLRNLEVVAQLQELASDLGVTISQLAIARVLAQPGVHVAIVGAQHLHYLQESARAADVTLSDADLAAVDNVLAAATPVGGPYPEMHQKAS

SEQ ID NO: 3978 - protein, 259 aa, Mycobacterium paratuberculosis
VSGPGLPLWLLLVCAVAAAIGVAVGAIWLGRRLLQGRQQNPAIASFLTVVGFVYGALLGFTVVATWEHFSSTQVVVSAEASALTTMYRQSVAMPEPERTEIQELLRKYAGAVAGPEWNKQRNEGARAAITRMYRTVGRQQPNIAARPINQQFLNQLSELASDRNERIVGTKPRIPPLLWAGLIFGAVVLVAFTGFLRLGSTVGHVVVSGTVAVLLALLLCTVFELDHSYATDQRITSGPFQHALDIFDAVDNDSRYFPR

SEQ ID NO: 3979 - protein, 935 aa, Mycobacterium paratuberculosis
MVEASEGTLEPIGAVQRTLVGREATEPMRADIRLLGAILGDTVREQNGQQVFELVERARVESFRVRRSEIDRAELARMFAGIDIHQAIPVIRAFSHFALLANVAEDIHRERRRAIHVAAGEPPQDSSLAATYAKLDRAQLDSAMVAEALRGAVVSPVITAHPTETRRRTVFVTQHRITELMRLHAEGHTETDDGRNIELELRRQVLTLWQTALIRLSRLQITDEIEVGLRYYAAAFFKVIPQVNAEVRNALRARWPGADLLDEPIVAPGSWIGGDRDGNPNVTADVVRRATGDAAYTALAHYLAELTACEQELSMSARLVAVTPELAALAEDCAEKARADEPYRRALRVIRGRLTATAAEILDRRPQHELDLGLPPYATPAELRADLDTVDASLRAHGSALLADDRLALLREGVRVFGFHLCGLDMRQNSDVHEEVVAELLAWAGVHPDYRSLPEDERVELLAAELGTRRPLVGDRAELSELADKELGVVRAAAHAIRRYGPAAVPNYVISMCRSVSDVLEAAILLKEAGLIDASGPEPYCPVGISPLLETIEDLHNGAAILHAMLELPLYRALVAARGQSQEVMLGYSDSNKDGGYLASSWAVYRAELALVEVARKIGIRLRLFHGRGGTVGRGGGPSYEAILAQPPGAVNGSLRLTEQGEVIAAKYAEPQVAQRNLESLVAATLESTLLDVEGLGDTAEPAYAVLDEVAVLAQRAYAELVHETPGFVDYFMASTPVSEIGSLNIGSRPTSRKPTESIADLRAIPWVLAWSQSRVMLPGWYGTGSAFEQWIAAGPQSRAERVDILHDLYRRWPFFRSVLSNLAQVLAKSDLGLAAQYAELVDDAALRRRVFGKIADEHRRTIAMHKLITGQDNLLADNPALARSVFNRFPYLEPLNHLQVELLRRYRSGDDDELVQRGILLTMNGLASALRNSG

SEQ ID NO: 3980 - protein, 305 aa, Mycobacterium paratuberculosis
MSAGIILMAHPDAANLVDDVIAQARRAHEFGVGQVWLAQQQSYDAIALAALVGAAVPGLGVGTSVVPINPRHPLIVASLAQTAQAAAHGNFSLGLGLGAADLERRTFGTEWPNTITRLREHLTILGSVFHSGAVDFHGSELSAAPSFPVRVPGGTPIPVYVAAMGPKALQVTGELADGTLPYLAGPRTIEEFIVPRITKAAAEAGRPAPRIIAAVPVLLSDDVEGARAAAAQQLSFYETIPSYRNVIAREGLSNAVELAAIGPEESVLRQVRRYFDAGATDVVLSPLDRSASVDREALWRLTAAL

SEQ ID NO: 3981 - protein, 77 aa, Mycobacterium paratuberculosis
MQLALQITLVVTSILVVLLVLLHRAKGGGLSTLFGGGVQSSLSGSTVVEKNLDRLTLFITGIWLVCIIGMALLIKYR

SEQ ID NO: 3982 - protein, 261 aa, Mycobacterium paratuberculosis
VSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAATALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 3983 - protein, 415 aa, Mycobacterium paratuberculosis
VAVHNLKDLLAEGVSGRGVLVRSDLNVPLDSDGEQGRITDPGRITASVPTLSALVEAGAKVVVAAHLGRPKNGPDPALSLAPVAAALGEQLGRHVQLASDVVGTDALARAEGLTDGDVLLLENIRFDARETSKDDAERLALARQLAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLLETEMVDTCRRLLDTYVDVLRLPVDIVAADRFAADAAPQTVPADAIPDDLMGLDIGPGSVKRFTALLSNAETIFWNGPMGVFEFPAFAAGTKGLAEAIAAATGKGAFSVVGGGDSAAAVRALGIPESGFSHISTGGGASLEYLEGKALPGIEVLGRPQPTGGAA

SEQ ID NO: 3984 - protein, 339 aa, Mycobacterium paratuberculosis
VTVRVGINGFGRIGRNFYRALLAQQEQGTADIEVVAVNDITDNSTLAHLLKFDSILGRLPYDVSLEGEDTIVVGPAKIKALEVREGPAALPWGDLGVDVVVESTGLFTNAAKAKGHLDAGAKKVIISAPATDEDITVVLGVNDDKYDGSQNIISNASCTTNCLAPLTKVLDDEFGIVRGLMTTIHAYTQDQNLQDGPHKDLRRARAAALNIVPTSTGAAKAIGLVMPNLKGKLDGYALRVPIPTGSVTDLTAELKKPASVEDINAAFKAAAEGRLKGILKYYDAPIVSSDIVTDPHSSIFDSGLTKVIDNQAKVVSWYDNEWGYSNRLVDLVALVGKSL

SEQ ID NO: 3985 - protein, 474 aa, Mycobacterium paratuberculosis
MARAVVVGAGPNGLAAAIQLARRGVEVQVLEAGETPGGGARSGELTLPGVIHDLCSATHPFGVGSPFWKEIDLPSYGLVWKWPQIDCAHPLDDGSAGVLYRSIEQTTAGMGPDATRWRRALGDLAAGFDQLASDLMRPVLRVPHHPVRLARFGPRALLPATVLARWFRTEQARALFGGAAAHIYTRLDRPLTASLGLLFLASGHRYGWPVAEGGSGSIIHALVAALRAHGGDVATGVTVSDRRDIPDADIVMLDLTPAAALRLYGELMPGRIARSYRRYRQGSSAFKVDFAVEGDIPWTNPHCARAGSVHLGGSFAEIADTERQRAQGKLAPRPFVLVGQQYLADPSRSAGGINPIWAYAHVPFGYTGDATALVVDQIERFAPGFRDRVVATVRRGTADLAAYNANYIGGDILGGANDGLQVILRPRVSVSPYATGVPGVYLCSQSTPPGPGIHGLCGYHAAEAALGWLRRRGG

SEQ ID NO: 3986 - protein, 581 aa, Mycobacterium paratuberculosis
MGFMTPEFPDVDPQTWTGLPRSTRRQIMTRHWVEHGFGSPYAVYLFYVFKIAGYIAGAAAVISLTPGLGGLGRIADWWTQPIVYQKLVVFTLLFEILGLGCGSGPLTARFWPPFGGFLYWLRPNTIRLPPWPDKVPFTAGDSRTVVDVALYLVVLGSGVAALLSPGRGGPVTAAGDVGLIDPVLVVPAIVALALLGLRDKTIFLAARGEHYGLTLLVFFFGFTDQIAAFKIIMLALWWGAATSKLNHHFPYVVAVMMSNSPLLRARAFNWFKRRLYLDPVDDLRPSWIPKVMAHVGGTTAEFLVPLVLVFVADGHRWAWFLIAFMVLFHLNIASTIPMGVPLEWNVFFIFSLFYLFGHYAGVTATGLSSPLLLGILIAALAVVPILGNLFPQQISFLPAMRYYAGNWATSTWCFRRGAEDKIEANITKASALVPNQLARLYDPQSAELMIDKLMGWRSMHTHGRALGGLVPRALPGGADEADYLLRDGEIVAGPLIGWNFGEGHLHNEQLLAAVQRRCNFDEGEVRVIILEAQPIQRQTQAYRIVDARTGLIEAGHVDVASMLSRQPWPEPGDEYPVHVHG

SEQ ID NO: 3987 - protein, 124 aa, Mycobacterium paratuberculosis
MDVAGLSPERRARSSAPHRTAGTPDRRGRRPATKPDAVPITQPHTVPDTADQQQADYFMRLLTGRRGLIDQRLDGYRQKIAKAEAKGDADAVAGLRRLTRIAEQDRQAVDGLIDKLRRRFARRA

SEQ ID NO: 3988 - protein, 269 aa, Mycobacterium paratuberculosis
VTDSDNADGGDIGKFDPVLTQRLMTVMRPVLKAYFRSEVHGLESFPPGGALVVGNHSGGMFPMDVPIFSVHFYDKYGYDRPIYTLSHDILMTGPTGDFFRRTGYIRANRENAAAALRSGGVVIVFPGGDYDAYRPTLAENVIDFDGRKGYVRTAIEAGVPIVPAVSIGGQETQLYLTRGTWLAERLGIKRLLRSAILPVSFGFPFGLSAVIPPNLPLPAKIVTRVLDPIDIAKQFGEDPDVDEVDEYVRSVMQQALNELAAERRFPILG

SEQ ID NO: 3989 - protein, 539 aa, Mycobacterium paratuberculosis
MPNPVRETLGLIATMRRARLLAPMRPDRYLRIAAAMRREGMGMTSGFAAAAQRCPDRPGLVDERGSLTWRQLDERCDALAAALQALQSGAPAVIGIMCRNHRGFVEALVAADRIGADIVLLNTSFAGPALADVITREGVNAVIYDEEFTATVDRALAGRPDAIRIVAWTDTEHQHTVDKLIASKAGARPIRTGRKGKMILLTSGTTGTPKGAKQSGGNAGIGTLKAILDRTPWRAEEPVVIVAPMFHAWGFSQLLLAASFACPVITRRKFDPEATLDLIDRHRATGLVVVPVMFDRIMDLPAEVRRRYECRSLRFAAASGSRMRPDVVVAFMDEFGDVIYNNYNATEAGMIATATPADLRAAPDTAGRPAGGTEIRILDPEFNELPAGEVGTIYVRNNTQFDGYTSGSSKDFHEGFMSSGDLGYLDSAGRLFVVGRDDEMIVSGGENVYPIEVEKTLATHPDVAEAAVIGVDDEQYGQRLAAFVVLAPEARTTPEALKQHVRDNLANYKVPREISVLDELPRSSTGKILRADLRARVGG

SEQ ID NO: 3990 - protein, 420 aa, Mycobacterium paratuberculosis
MRTLRKPRPLARATLELANAANGFRPLARKGYSTVLVFWFGWPASEVPGIYFSASLLDALRRGRRGDFAGRRGKAALALTAASWAILGVIKYRGITTAGPVLEAGLRDQLGDDYTEALNKLPQSRPTRSGRRTLPLGNIVARRRYVEKTNVVSYGPHGRANLADIWRRRDLPRDGKAPVLLQVPGGAWAIGMRRPQAYPLMSHLAARGWVCVSIGYRVSPRHTWPDHIVDVKRALAWVKENIARYGGDPNFVAITGGSAGGHLCSLAALTPNDPKYQPGFEDADTSVVAAVPVYGRYDWFTTEGEGRREFVQLLEKFVVKKKFATHRDIYVDASPIRRLRADAPPFFVLHGRDDSLIPVGEAQEFVEELRAVSKSPVAYAELPHAQHAFDIFSSPRAHRSAEAVARFLSWVYATNPPERD

SEQ ID NO: 3991 - protein, 105 aa, Mycobacterium paratuberculosis
MVEPFIGSEAVADGEVVKSALRTRYKRLFRDVYIHPGAELSALTRARAGWLWSRRRGVIAGRRLPPFTAPGGWTRRHRWRFCIATETRCRDCGFTVTALKATNTP

SEQ ID NO: 3992 - protein, 234 aa, Mycobacterium paratuberculosis
MAVVASARRHRWPSAAAVHGARWVDATAPLEILHSNRNPLPGLRIHSDRLESDEYALIDGVPVTTPARTAVDLGCWHPVNDAVAVIDDLLRATDCKVAECQLLADRYPGRRGMQSARAAIGLADAGAQSPKETWLRLLLIRAGLPRPQTQIPVSEEFGGVTYYLDMGWEDFMVAAEYDGEQHRRDRWQYTWDIRRRETLERLGWIVIQVVAGDRPADIVSRVSAALARRGVTLA

SEQ ID NO: 3993 - protein, 464 aa, Mycobacterium paratuberculosis
MKRLSSVDAAFWSAETAGWHMHVGALAICDPKGSAEYSFERLRQLLIERLPEVPQLRWRVTGAPLGLDRPWFVEDEELDVDFHLRRIGVPAPGGRRELEELVGRLMSYKLDRSRPLWEMWVIEGLDGNAGGRFATLTKMHHAIVDGVSGAGLGEILLDATPEPRPPQQETVGSLVGFQLPGLERRAVGALINVGVKTPFRIARLLEQTVRQQVATLGVRSRPPRYFEAPKTRFNAPVSPHRRVTGCRVELARAKAIKDAYDVKLNDVVLALVAGAVRDYLQKRGELPAKPLIAQIPVSTRTDENKDDIGNKVSSMTVSLATHIEDPGERLRAIHDSTQSAKLMAKALSAHQIMGLTETTPPGLLHLAARAYTASGLSRNLAPINLVVSNVPGPPFPLYMAGAKLDSLGPPVMDVALNITCFSYTDYLDFGFVTTPEVANDIDDMADRIEPALTDLEKAAAGETG

SEQ ID NO: 3994 - protein, 320 aa, Mycobacterium paratuberculosis
MDFGTRAPESNSGRMHSGPGAGSLMDAAKAWGVLGAQLADTALTYRAVIAELELGDQRASTTAITQAVAPYLAWLDATAARARQTATQATAAAGAYGLALAAVVAPHVIAANRLRRISLAEANCLGQLSPAVADADADYERMWAQDAAAMYAYARASAGVWKLTPFDSPPPAADPAPAGVTSPSRNWALTAAPEVITTGRQVISTISDALGALSVSPLATFDTSLLSATGALSRLSSLSAPLDFALNHLSALNKAAALGRAAVMCSPRPGGGGGTNSAALRVSVGRGAAIGILSVPRAWTRSVPSPASPNSPAAPLDRSQ

SEQ ID NO: 3995 - protein, 117 aa, Mycobacterium paratuberculosis
MKLLLALLGVALGIVTAVPAQAVPGEDEAATDDNNEVFIADLHKVGISFQDPGQAVSAGKAVCGLLARGVSGLQLLNDLRDNNPALTTNGAAQFATISAKSYCPRQLESAEAGKGGG

SEQ ID NO: 3996 - protein, 454 aa, Mycobacterium paratuberculosis
MVFSDFATLPPEVISTQIHVGPGAVPLLAAAAAWDGLAAELHGTAASYASVISELVVESWQGSSSGSMAAAAAPYVAWLSATAGLAEQTAAQARAAAAAYEAAVAATVPPAVVAANRSLLATLLQTNILGQNDAAIAATEDEYGQMWAQDVAAMFSYAAASESAGELTPFEQAPATTNDAGPATQAAAAAAAESTSLSSWLKQLEAYITSLTGQYTQFWQNLIGGATGSTEIAPFWETLYSSISQVGTQATWTNVVNATIGLGVSQWKNFFIYAPWSAAMAKSSLGAGLASPGHIASGIAAKPVSAVLGNAPTVGKLSVPAGWATAAPAIRLASTALPATSLAAAAATDFSGLVNEATLGSLAGGALGSPAARVVSTTGIPTRAITGERRQGPVKLDRIIAQLQEMPEQVQHWNVDEAGLDDLVARLRTTPGVHAVHVTDGEQVAVGSPASKLG

SEQ ID NO: 3997 - protein, 416 aa, Mycobacterium paratuberculosis
MDFGSLPPEINSGRIYSGPGSAPLLAAAAAWHGLAAEMHSAAASYGSAIAELRTLWHGPSSTAMAAAAAPFIAWLGGTAAQAEQTAAQATAAAAYDSVFAATVPPPVIAANRALLASLIATNVLGQNTPAIAATEAHYAEMWAQDAAAMYAYAGASAVATRLTPFGAPPQSADANAAADQSAAAASALQLSTASSVESALSQGVSQVPVAAQVNATAVTAAAQLPLSLTDITGILKTFNSVMGTISGPYTPLGVANLAKNWYQIALSIPSVGTGIQGIGPLLHPKALTGVLAPLLRSDLLTGSTALSSAGTVSASAGRAGLVGSLSVPANWASAVPAVRTVAAELPETMLDAAPAMAVNGQQGMFGPTALSSLAGRAVGGTATRAVAGSTVRVPGAVAVDDLATTSTVIVIPPNAK

SEQ ID NO: 3998 - protein, 98 aa, Mycobacterium paratuberculosis
VSPRPARSVPPPAHHHEFAGRRSCPRVAETLARGYGIALRHDRPASPAPPGRAASAGSRRFGEQVADIPLYLGQIRHGEAVNGCRKAGAGVPRAAIGE

SEQ ID NO: 3999 - protein, 411 aa, Mycobacterium paratuberculosis; identical to SEQ ID NO: 1383

SEQ ID NO: 4000 - protein, 411 aa, Mycobacterium paratuberculosis; identical to SEQ ID NO: 1383

SEQ ID NO: 4001 - protein, 325 aa, Mycobacterium paratuberculosis
MTTEVKDELSRLVVKSVSARRAEVTSLLRFAGGLHIVGGRVVVEAEVDLGNVARRLRKDIFELYGYNAVVHVLSASGIRKSTRYVLRVANDGEALARQTGLLDNRGRPVRGLPAQVVGGSIADAEAAWRGAFLAHGSLTEPGRSSALEVSCPGPEAALALVGAARRLGVSAKAREVRGADRVVVRDGEAIGALLTRMGAQDTRLIWEERRMRREVRATANRLANFDDANLRRSARAAVAAAARVERALEILGDTVPDHLASAGKLRVEHRQASLEELGRLADPPMTKDAVAGRIRRLLSMADRKAKIEGIPDTESAVTPDLLEDA

SEQ ID NO: 4002 - protein, 358 aa, Mycobacterium paratuberculosis
MSEPINRGIVALGGGHGLYATLSAARRLTPYVTAVVTVADDGGSSGRLRSELGVVPPGDLRMALAALASDSPHGRLWATILQHRFGGSGALAGHPIGNLMLAGLSEVLADPVAALDELGRILGVKGRVLPMCPIALQIEADVSGLEADPRMFRVIRGQVAIATTPGKVRRVRLLPDNPPATRQAVDAIMAADLVVLGPGSWFTSVIPHVMVPGLAAALWATTARRALVLNLVAEPGETAGFSVERHLHVLVQHAPGFTVHDIIIDAERVPSEREREQLRRTATLLSAEVHFADVARPGTPLHDPGKLAAALDGVRAARKAPGASPVTATADIRVDGASPPAGGNGPAGSGPRGDDAWR

SEQ ID NO: 4003 - protein, 310 aa, Mycobacterium paratuberculosis
VTGPGELAGSRPVDAHLENGAGIDVVLVTGLSGAGRGTAAKVLEDLGWYVADNLPPQLITRMVDLGMDAGSRITQLAVVMDVRSRGFTGDLDSVRTELATRNIAPRVVFMEASDDMLVRRYEQNRRSHPLQGDQTLAEGIAAERRMLAPVRATADLIIDTSTLSVRALRETIERAFGGGANATISVTVESFGFKYGLPMDADMVMDVRFLPNPHWVDELRPRTGQDPAVRDYVLGQPGAAEFLDAYHRLLSLVVDGYRREGKRYMTVAIGCTGGKHRSVAIAEALMQRLQAQHGEAQLSVRVLHRDLGRE

SEQ ID NO: 4004 - protein, 587 aa, Mycobacterium paratuberculosis
VTTAAKVEWTVVNTEVEALQLEYNWIKEFDPRFNVRYRDDKSYPVLAVTLNEEFPRLMVYRGPRRKGVRYFGPYSHAWAIRETLDLLTRVFPARTCSAGVFKRHKQIDRPCLLGYIDKCSAPCIGRVSAEQHRQIVDDFCDFLSGKTDRFARELEQQMNAAAAELDFERAARLRDDLGALKRAMEKQAVVLGDGTDADVVAFADDELEAAVQVFHVRGGRVRGQRGWIVEKSADPGDSGEEQLVEQFLTQFYGEQAELGGAADESVNPVPREVLVPCLPSNADELTSWLSGLRGSRVALRVPRRGDKRALAETVQRNAKEALQQHKLKRAGDFNARSAALQNIQEALGLSEAPLRIECVDISHVQGTDVVGSLVVFEDGLPRKSDYRHFAIREAAGQGRSDDVASIAEVTRRRFARHLSEQNDPNMLSPEGKSRRFAYPPNLYVVDGGAPQVNAASAVLEELGITDVAVIGLAKRLEEVWVPSEPDPVIMPRNSEGLYLLQRVRDEAHRFAITYHRSKRSKRMTASVLDSVPGLGEHRRKALVSHFGSIARLKEATVDQITAVPGIGVATATAVLEALRPDESKAAP

SEQ ID NO: 4005 - protein, 393 aa, Mycobacterium paratuberculosis
LAVESSLAWLLRSLGVDAFLNEIWATRHHHIDRCRPGYFDGLLPGPSAVDGLLEQVRPDPAAVRLVKDGEDRDPAGYRRGDGTLNAGGARDGLADGYTLVLNGLERYLRTVASLSHAIEVELNFPTRVNAYVTPPHSTGFVPHYDPHDVLVLQIEGCKTWRVSDEPPVPPQQIQSRKGVGADGPASWTDVCLRPGDVLYLPRGQVHSARTHSEPSVHLTVGLHAPTVLTLVTSALHALSLRDPRVHDRLPPRHLDDAQVRAGLGEAVRDAVRALDDDAVIADGLGAMEEVLVRRGRCPPVGSVRDTVGVDGHTLVRKHQPLYARVMRAGDGVVLQFAQLSVSAGSDHEAAMLFLAGRAEPFRVAELPGLSAAQQVGLAQTLILNGFLARLSDD

SEQ ID NO: 4006 - protein, 362 aa, Mycobacterium paratuberculosis
MTMPIWAAFPPEVHSAALSSGPGPGSLLAAEQAWQALSAEYASAAAELGDLLAAVQAGTWQGPSAEAFVAAHVPYLAWLLQNSTNSTAAAREAETVAAAYTAALSAMPTLEQLATNHAVFAQLVATNFFGVNTIPIAQNEIEYLQMWLQAATTMAIYEAVSETAMTWKPPTAPPPQIQKTGVANQDAGGGPTQLSWWVTRVQEVARAISGDLSQSPSNPSATLSDLMSDPLLATEVPHWAGESLLYFTPQVPQLTQLSFGLIAPFIPAAGAPGVAGLAGLAGLAGGAPAPVLPGVAAAPSGGGAAAVLAPGPGASAATVSPAPAPAGMPATAPAPVGPPTPPPATGVPGFSAPYAVGPPGLG

SEQ ID NO: 4007 - protein, 111 aa, Mycobacterium paratuberculosis
MKRSLAKLAVTVGGLALASTAGAGVASADPDYGPMINTTCSYDQAMRAVHAENQMAAQYLDQSPPNQQFLQQYLASSPDQRVNLLHAIEHNQGAQQALPIFQQMMTDCTRY

SEQ ID NO: 4008 - protein, 154 aa, Mycobacterium paratuberculosis
VTPPEPERWDVVLRPHRTPLFVYGAAVLIAAAHIALGLLLKVGSTGVVFRTSDQVAIAVLGLVIAGVVLLFARPRLRIGPAGVSVRNLLGDKLIEWPDVVGVSFPVGHRWARIDLPDDEYIPVMAIQAVDKGRAVDAMDTVRSLLARYRPDLQG

SEQ ID NO: 4009 - protein, 160 aa, Mycobacterium paratuberculosis
MSPAAGVPEMPALDASGVRLGIVASTWHSRICDALLAGARKVAADSGVDNPTVVRVLGAIEIPVVAQELARNHDAVVALGVVIRGQTPHFEYVCDAVTQGITRVSLDASTPVANGVLTTDNEQQALDRAGLPESAEDKGSQAAGAALSAALTLRELRARS

SEQ ID NO: 4010 - protein, 425 aa, Mycobacterium paratuberculosis
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGVGTGISASDRATTMRLLADPTSIAEDFTRPGHVVPLRAKDGGVLRRPGHTEAAVDLARMAGLQPAGAICEIVSQKDEGSMAQTDELRVFADEHDLAMITIADLIEWRRKHEKHIERIAEARIPTRHGEFRAIGYTSIYEEVEHVALVRGEIAGPNSDGDDVLVRVHSECLTGDVFGSRRCDCGPQLDAAMAMVAREGRGIVLYMRGHEGRGIGLMHKLQAYQLQDAGEDTVDANLKLGLPADARDYGIGAQILVDLGVRSMRLLTNNPAKRVGLDGYGLHIIERVPLPVRTNAENIRYLMTKRDKMGHDLAGLDDFHESVHLPGEFGGAL

SEQ ID NO: 4011 - protein, 199 aa, Mycobacterium paratuberculosis
MFTGIVEELGEVTARDVLADAARLTIRGAVVTADAGHGDSIAVNGVCLTVAELLPDGRFSADVMGETLNRSNLGALQVGSRVNLERAAAVNSRLGGHIVQGHVDGTGRIVARTPSEHWEVVRIEVPPEVARYVVEKGSITVDGISLTVSGLGGEPRDWFEVSLIPTTRELTTLGGAPVGTQVNLEVDVIAKYVERLMSR

SEQ ID NO: 4012 - protein, 238 aa, Mycobacterium paratuberculosis
MLGMQTRRRLSAVFASLTLATALIAGCSSGSKQSGAPLPDPTSLVKQSADATKNVKSVHLVLSIQGKISGLPIKTLTGDLTTTPATAAKGNATITLGGSDIDANFVVVDGTLYATLTPNKWSDFGKASDIYDVSVLLNPDNGLGNALANFSNAKAEGRETINGQSTIRISGNVSADAVNKIMPQFNATQPVPSTVWVQETGDHQLVQANLQKSSGNSVQVTLSNWGEQVQVTKPPVSS

SEQ ID NO: 4013 - protein, 532 aa, Mycobacterium paratuberculosis
LGRAGPGHQAPGELVTAQTGRRVAISAGSLAVLLGALDAYVVVTIMRDIMTDVHIPINQLQRITWIITMYLLGYIAAMPLLGRASDRFGRKLVLQVSLALFMVGSVVTALAGHWGDFHLLIGGRTIQGVASGALLPVTLALGADLWAQRNRAGVLGGIGAAQELGSVLGPLYGIFIVFLFHDWRYVFWINVPLTLIAMVMIQFSLPSHEKVEQPEKVDLVGGVLLAVALGLAVIGLYNPEPDGKQILPSYGLPLVLGAVVVGILFLLWERFARTRLIEPAGVHFRPFLAALGASLFAGAALMVTLVDVELFGQGVLGQDQTQAAGLLLWFLIALPIGAVLGGWIATRVGDRAMTFVGLLIAAYGYWLIHYWRQDVLSQKHNVLGLFSVPVLHADLLVAGVGLGLVIGPLTSAALRVVPSAQHGIASAAVVVARMTGMLIGVAALSAWGLYRFNQIVANLTAAIPPNASLLERIAAQGTMYLKAFAMMYGDIFAATVVICIAGALLGLLIGGRKEHAEEPEIVEPQAVSLGER

SEQ ID NO: 4014 - protein, 341 aa, Mycobacterium paratuberculosis
MTASLGDRLDAAMHLAIEQSNQVKGNTYPNPPVGAVVLDGRGEVVGVGGTEPAGGDHAEILALRRAGDLAAGGTVVVTLEPCNHHGKTPPCVDALLEAGVGTVVYAVADPNPQAAGGAGRLQEAGVTVRSGLLADEVSGGPLREWLHKQRTGLPHLTWKYASSVDGRSAAADGSSRWISSEASRLDLHRRRAAADAIVVGTGTVLADDPALTARLPDGTLADRQPLRVVVGMREILSEAKVLNEESRTMVIRTHDPAEVLKAVSDRTDVLLEGGPTLAGAFVRAGLVNRILVYLAPTLLGGPVTAVDDVGVPTIAKALRWQFDGVDRVGPDLLLSLVPRSG

SEQ ID NO: 4015 - protein, 232 aa, Mycobacterium paratuberculosis
MPCNTGQPRGPLIAPSILSADFSRLADEAAAVTGADWLHVDVMDNHFVPNLTIGLPVVQSLLATTTIPMDCHLMIENPDRWAPPYAEAGAHNVTFHAEATDNPIGVARDIRAAGAKAGISVKPGTPLEPYLEILPQFDTLLIMSVEPGFGGQSFIPEVLGKVRTARKLIDAGELTILVEIDGGINADTIEQAAEAGVDCFVAGLAVYGADDPAAAVEALRRQALGASQHLRR

SEQ ID NO: 4016 - protein, 464 aa, Mycobacterium paratuberculosis
MSRPQQRGRANRRRPLDPARAAAFEVLRAVSERDAYANLALPALLRERGIIGRDAAFATELTYGTCRTRGLLDAVIGAAAGRPPEAIDPVLLDLLRLGTYQLLRTRVDAHAAVSTTVEQAAIEFDSARAGFVNGVLRRIAGRDERSWVQELAPDPARDPIGHAAFVHAHPRWIAQAFADALGAAAAELDAVLASDDERPQVHLAARPGVLTAAELADAVGGTVGRHSPFAVYLAGGDPGRLAPVRDGLALVQDEGSQLVARALTLAPVDGDCGRWLDLCAGPGGKTALLASLGAQRFSESQFRVTAVEPAPRRADLVVENTRGLPVEVLRVDGRHTGLQPAFDRVLVDAPCTGLGALRRRPEARWRRQPGDVPALTKLQRELLGAAIALTRPGGVVLYATCSPHLAETVGVVADALRRHPVSALDARPLFEPVADLGDGPHVQLWPHRHGTDAMFASALRREAG

SEQ ID NO: 4017 - protein, 315 aa, Mycobacterium paratuberculosis
VRLVFAGTPEPALPALRRLLDSPRHEMIAVLTRPDAASGRRGKPEPSPVAREALDRGIPVLRPARPNSPEFVAELAQLAPDCCAVVAYGALLRDELLAVPPHGWINLHFSLLPAWRGAAPVQAAIAAGDIITGASTFRIEPALDSGPIYGVVTEAIRPTDTAGELLARLAVSGAELLSATLDGIADSTLTPRPQPAEGVSIAPKITVEQARVRWDLPAPVVERRIRAVTPNPGAWTVISDLRIKLGPVRLGAASDLPAPPEPLPPGAIHVDRKSVWVGTGSDPVRLGQIQPPGKKFMNAVDWARGARLDPAARAT

SEQ ID NO: 4018 - protein, 274 aa, Mycobacterium paratuberculosis
MTLDTTTADASVAARHRTVWALGDYALMAEEVMAPLGPTLVEAAGIGPGVRVLDVAAGSGNITLPAAAGASVVSTDLTPELLQRSRDRAAGMGLTIDYREANAQALPFGDGEFDAVVSAIGVQFAPDHQRAADELVRVCRPGGRIGLISWTPEGFFGRMLATIRPYRPSLSHPVPPAALWGRPGYVRALLGERIGEITTARGMLPVNRFGSAEDVHAYFKQHYGPTIEAYANIGHNRVLAAELDAQLVELAAQHLSDGTMGWEYLLVTAEKRSG

SEQ ID NO: 4019 - protein, 161 aa, Mycobacterium paratuberculosis
MAADHTTVDESLDAITDALLTASRLLMAISARSVGQVDETITIPQFRTLVILSNRGPVNLATLAGLLGVQPSATGRMVDRLVAAGLIDRLPHPTSRRELLAALTTRGRDVVHQVTAHRRAEIAAIVAKMPPAERHGLVRALTAFTAAGGEPDVHLDAEIDL

SEQ ID NO: 4020 - protein, 655 aa, Mycobacterium paratuberculosis
MLSVPHLDREFDYLVSAEQSDDAQPGVRVRVRFHGRLVDGFLLERRHDTDHQGKLGWLDRVVSPEPVLTAEIRRLVDAVAARYAGTRPDVLRLAVPARHARVEREARAAAGIPMPAPVDPSGWDGYGRGAQFLAALAESRAARAVWQALPGEPWTDRFAEAAAQTVRTGRSVLAIVPDQRDLDALSHAVTSRIDATGVVALSAGLGPAARYRRWLAALRGSARVVIGTRSAVFAPLSDLGLVMVWADADDSLAEPRAPYPHAREVAMLRAHQARCAALIGGYARTAEAQALVRSGWAHDIVAARPVVRARTPRVIALDDTGYADERDPAARTARIPSVALRAARSALQDGAPVLVQVPRRGYVPSLACARCRTIARCRHCTGPLSLAESPGEGGGGLVCRWCGRVDPTRRCARCGSDAVRAVVVGARRTAEELGRAFAGTTVITSSGDAVVPEVADGPALVVATPGAEPRARGDYGAALLLDTWALLGRQDLRAAEDALWRWMTAAALVRPRGDGGVVMVVAESSLPTVQSLIRWDPVGHAESELTARAEVGLPPSVHMAAVDGTPAAVNALLDEAGLTGGQTLHADLLGPVDLPPGARRPAGTPPGAPVTRMLVRVPRRDGLALAAALRRGVGVLSARQTHEPARVQIDPLHIG

SEQ ID NO: 4021 - protein, 263 aa, Mycobacterium paratuberculosis
MEVPYAPRLVAGAWVVAGWVALAYGIYLTVLALRSPPGVELTGHWVLQPAFKASMALLLTLAAAGHGQVRERRWLMPALLLSAVGDWVLALPWWTLSFLVGLAAFLFAPMCFIGVLLPLVPLPSGASGPGRPSTPRIAAAVLMCLASIGLLVWFWPRLGPDKLTLPVTLYIVVLTAMVCAALLAKLPTIWTAVGAVCFAASDSMIAIGRFILGNEALAVPIWWAYAAAQILITAGFFFGREAAGDAAGEATGDATGDAAEPVE

SEQ ID NO: 4022 - protein, 320 aa, Mycobacterium paratuberculosis
MPRLDNPADEKPGIDPILQKVLDAVPFRLSTEDGIDAARQRFRDLPRRPLHPELRVEDRTIPGPQGAIAVRIYWPPSHSESCPAPVVLYFHGGGFVIGDLDTHDGTARQHAVGAGAIVVSVDYRLAPEHPYPAAVEDAWAATLWAAENAAGLHGDPGRIAVAGDSAGGTLAAVTAQRARDRGGPPVRFQLLWYPSTMWDASLPSFAENATAPILDVKAVAEFSRWYAGDVDLSDPPADMAPGRATDLSNLPPAYIGVAGYDPLRDDGIRYGEPLAAAGVAAQVHNAETLVHGYLGYAGVVPAATAAMERGLAALRTALQG

SEQ ID NO: 4023 - protein, 496 aa, Mycobacterium paratuberculosis
MSSPAVPDHHTLIIGAGFSGIGAAIKLDKAGLPDYRVIEAGDGVGGTWHWNTYPGIAVDIPSFSYQFSFEQSRHWSRTYAPGRELKAYAEHCADKYGIRSRIRFNTKVLAAEFDDEPRLWRVHTDPGGTVTARFLISACGVLTVPNLPDIDGVDSFGGITMHTARWDHGQDLSGKRVAVIGTGASAVQVIPEIAPIVKSLTVFQRTPIWRFPKLDVPLPAPARWAMRIPGGKSVQRLLSQAYVEVTFPISAHYFTVLPLAKRMATLGKSYLRQQVRDPEVREKLTPKYAVGCKRPGFHNGYLATFNRDNVRLVTEPIDKITPDAVATTDGEHHRIDVLILATGFKVMDPDNVPTFAVTGPGGRSLSRFWDEHRLQAYEGVSVPGFPNLFTVFGPYGYVGSSYFALIEAQTHHIVRCLKRAERLGAARVEVSEEANARYFAEMMRRRHRQIFWQDSCKLANSYYFDKNGDVPLRPGTTPEVYWRSRRFNLDDYRFSA

SEQ ID NO: 4024 - protein, 403 aa, Mycobacterium paratuberculosis
VSEKGRLFTSESVTEGHPDKICDAISDSVLDALLAQDPRSRVAVETLVTTGQVHVVGEVTTTAKEAFADITNTVRERILDIGYDSSDKGFDGASCGVNIGIGAQSPDIAQGVDTAHETRVEGAADPLDAQGAGDQGLMFGYAIKDTPEMMPLPIALAHRLSRRLTEVRKSGVLPYLRPDGKTQVTIEYEDDVPVRLDTVVVSTQHAADIDLENTLTPDIREKVLNTVLDDLAHDTLDTSSTRLLVNPTGKFVVGGPMGDAGLTGRKIIVDTYGGWARHGGGAFSGKDPSKVDRSAAYAMRWVAKNIVAAGLAERVEVQVAYAIGKAAPVGLFVETFGTATVDPVKIEKIVPEVFDLRPGAIIRDLDLLRPIYAQTAAYGHFGRTDVELPWEQLNKVDELKRAV

SEQ ID NO: 4025 - protein, 420 aa, Mycobacterium paratuberculosis
VYDRNRASTRAARIVVGVSGGIAAYKACTVVRQLSEAGHSVRVIPTESALRFVGAATFEALSGQPVHTGVFDDVPEVPHVQLGKQADLVVVAPATADLLARAVHGRADDLLTATLLTARCPVLFAPAMHTEMWLHPATVDNVATLRRRGAVVLEPAAGRLTGTDSGSGRLPEAEEITTLAQLLLERHDALPYDLAGCKMVVTAGGTREPVDPVRFIGNRSSGKQGYAVARVAAQRGAEVTLIAGHTAGLIDPAGVEVVHVSSAEQLGNAVSKHAAEADVLVMAAAVADFRPARVAAAKIKKGVEAPTIELVRNDDVLAGAVRARAHGELPNLRAIVGFAAETGDANGDVLFHARAKLRNKGCDLLVVNAVGEGRAFEVDSNDGWLLAADGTESALQHGSKTLMASRIVDAIAAFLRGDGG

SEQ ID NO: 4026 - protein, 108 aa, Mycobacterium paratuberculosis
VTNSQSDAALAAVLDRFDPSAGGPGAYDTPLGITNPPIDELLDRVSSKYALVIYAAKRARQINDYYNQLGEGILEYVGPLVEPGLQEKPLSIALREIHGDLLEHTEGE

SEQ ID NO: 4027 - protein, 223 aa, Mycobacterium paratuberculosis
VTADGGPDVRHGTRPEPSGDGRVVVLSGPSAVGKSTVVRCLRERVPNLHFSVSATTRAPRPGEVDGVDYHFVSPARFQQLIDEGALLEWAEIHSGLHRSGTLAAPVRAAVARGCPVLIEVDLAGARAVKKAMPEALTVFLAPPSWEDLEARLIGRGTETPEVIARRLQTARVEMAAQHDFDRVVVNSRLESACAELVSLLVGTAPDRHDTSGRTGRQTTSHPD

SEQ ID NO: 4028 - protein, 111 aa, Mycobacterium paratuberculosis
LIRYGGIVALPQLTDEQRAAALEKAAAARRARAELKDRLKRGGTNLSQVLKDAETDEVLGKMKVSALLEALPKVGKVKAQEIMTELEIAPTRRLRGLGDRQRKALLEKFGS

SEQ ID NO: 4029 - protein, 152 aa, Mycobacterium paratuberculosis
MREPPRRRRAQPRSTSHATSPRPPTRRYMLGVCPVKQGGGLDFVRRPEYGRLRWLKYPAETQRDRLRLIDQIRRNRGPSPVDRRAARGRVGEGGCRTSSPSRAQRPAEARRHQPQSGAQGRRDRRSPGQDEGFGASRGVAQGGQGQGAGNHD

SEQ ID NO: 4030 - protein, 165 aa, Mycobacterium paratuberculosis
VDRRSRRVTASLAADQGAAIGYHRGVSNLRIRQAAELLGVSDDTVRRWINQGALEVGHDAAGRKVIASEDLAHFSRTNAPAPPADPLSIGSSARNRFVGLVTSVVSDKVMTQVEMQCGPFTVVSLMSTEAAEELQLRPGSVAVAVVKATTVIVETARPSTTVASD

SEQ ID NO: 4031 - protein, 274 aa, Mycobacterium paratuberculosis
VTGFGARLAAAKAQRGPLCVGIDPHPELLRAWDLPTTADGLAAFCDICVEAFAGFAVVKPQVAFFEAYGAAGFAVLERTIAALRSAGVLVLADAKRGDIGTTMAAYAAAWAGDSPLAADAVTASPYLGFGSLRPLLEAAAAHDRGVFVLAATSNPEGATVQRAAFDGRTVAQLVVDQAAVVNRSTNPAGPGYVGVVVGATVLQPPDLSALGGPVLVPGLGVQGGRPEALAGLGGAEPGQLLPAVAREVLRAGPDVAELRAAADRMLDAVAYLDA

SEQ ID NO: 4032 - protein, 1117 aa, Mycobacterium paratuberculosis
VPRRTDLNHVLVIGSGPIVIGQACEFDYSGTQACRVLKAEGLQVSLVNSNPATIMTDPEYADHTYVEPITPAFVERVIAQQAERGNKIDALLATLGGQTALNTAVALYENGALDRYGVELIGADFDAIQRGEDRQRFKDIVAKVGGESARSRVCFTMDEVRETVAELGLPVVVRPSFTMGGLGSGMARSVEEVDRMAGAGLAESPSANVLIEESIYGWKEFELELMRDGNDNVVVVCSIENVDPMGVHTGDSVTVAPAMTLTDREYQRMRDLGIAILREVGVDTGGCNIQFAVNPKDGRLIVIEMNPRVSRSSALASKATGFPIAKIAAKLAIGYTLDEIVNDITKETPACFEPTLDYVVVKAPRFAFEKFPGADPTLTTTMKSVGEAMSLGRNFIEALGKVMRSLETSRAGFWTKPDPDGGLDDVLARLQTPTEGRLYDLELALRLGAPVERVAQASGVDPWFIAQIGELVALRGELIGAPVLDADLLRRAKHHGLSDRQIAALRPELAGENGVRSLRERLGVHPVYKTVDTCAAEFEAKTPYHYSSYELDPAAETEVAPQAQRPKVLILGSGPNRIGQGIEFDYSCVHAATTLSQAGFETVMVNCNPETVSTDYDTADRLYFEPLTFEDVLEVFRAEQQSGAGGPGVVGVIVQLGGQTPLGLAQRLADAGVPIVGTPPEAIDLAEDRGSFGDVLTAAGLPAPKYGTATTFAQARRIAEDIGYPVLVRPSYVLGGRGMEIVYDEETLRDYITRATELSPEHPVLVDRFLEDAVEIDVDALCDGTEVYIGGIMEHIEEAGIHSGDSACALPPVTLGRSDIEKVRRATEAIAHGIGVVGLLNVQYALKDDVLYVLEANPRASRTVPFVSKATAIPLAKACARIMLGATISQLRAEGMLAASGDGAHAALNAPIAVKEAVLPFHRFRTVEGAGIDSLLGPEMKSTGEVMGIDRDFGSAFAKSQTAAYGSLPAQGTVFVSVANRDKRSLVFPVKRLADLGFRVLATEGTAEMLRRNGIPCDEVRKHFEDPQPGRPEMSAVDAIKAGEVDMVINTPYGNSGPRIDGYEIRSAAVSVNIPCVTTVQGASAAVQGIEAGIRGDIGVRSLQELHSQIASDKGPR

SEQ ID NO: 4033 - protein, 373 aa, Mycobacterium paratuberculosis
VSGKAQLVLEDGRVFTGTAFGAIGQTLGEAVFSTGMSGYQETLTDPSYHRQIVVATAPQIGNTGWNGEDAESRGDKIWVAGYAVRDPSPRVSNWRATGSLEDELIRQRIVGIARIDTRAVVRHLRTRGSMKAGVFSGDALADPDELVQRVRGQQSMLGADLAGEVSTPDAYIVEPEGPPRFTVAALDLGIKTNTPRNFARRGIRSHVLPSSATFEQIADLRPDGVFLSNGPGDPATADHIVAVTREVLGAGIPLFGICFGNQILGRALGLSTYKMVFGHRGINIPVIDHATGRVAVTAQNHGFALQGEAGQSFDTPFGAAVVSHTCANDGVVEGVKLADGRAFSVQYHPEAAAGPHDANYLFDQFIELMEGDR

SEQ ID NO: 4034 - protein, 170 aa, Mycobacterium paratuberculosis
MNSGTLVGSLIFAAVLVVVIAVVIQLMMRGWMRRARRQAELIGELPGVPDKVGTATATLQGVYVGCTLSPAWNDRVTAGDLGYRSKAALTRYPEGILLERIRATPIWIPQQSISAVRTERGMAGKVAARNSILAIRWRLPSGVEIDTGFRANNRGEYDGWLQPGREERRS

SEQ ID NO: 4035 - protein, 380 aa, Mycobacterium paratuberculosis
MSVLLRGVRLYGEGDRVDVLVDDGQIADIGAGLDIPDTADVIDATGQVLLPGFVDLHTHLREPGREYAEDIETGSAAAALGGYTAVFAMANTNPVADSPVVTDHVWHRGQQVGLVDVHPVGAVTMGLAGKELTEMGMMAAGAAQVRMFSDDGVCVHDPLVMRRALEYATGLGVLIAQHAEEPRLTVGAVAHEGPTAARLGLAGWPRAAEESIVARDALLARDAGARVHICHASTAGTVEIVKWAKQQGISITAEVTPHHLMLDDSRLASYDGRNRVNPPLREAADAAALRRALADGVIDCVATDHAPHAEHEKCVEFSAARPGMLGLQTALSIVVHTMVRPGLLTWRDIAKVMSENPARIANLPDHGRPLEVGEPANLTV

SEQ ID NO: 4036 - protein, 318 aa, Mycobacterium paratuberculosis
MTRHLLAAGDLSRDDATAILDDADRFAQALVGREIKKLPTLRGRTVVTMFYENSTRTRVSFEVAGKWMSADVINVSAAGSSVGKGESLRDTALTLRAAGADALIIRHPASGAAHLLAEWTCGNGDSSDAGPSVINAGDGTHEHPTQALLDALTIRQRLGGIEGRRVVIVGDVLHSRVARSNVMLLSTLGAEVVLVAPPTLLPVGVEGWPVTVSNDFDAELPAADAVLMLRVQAERMNGGFFPSVREYSSLYGLSDRRQAMLPGHAVVLHPGPMLRGMEIASSVADSSQSAVLQQVSNGVHVRMAVLFHVLVGAEEIAA

SEQ ID NO: 4037 - protein, 190 aa, Mycobacterium paratuberculosis
MGAAGNTGSSGDSRELMSAADVGRTISRIAHQIIEKTALDGPDGPRVVLLGIPTRGVTLADRLARNIGEYSGVEVGHGALDITLYRDDLMQKPPRPLEATSIPAGGIDDALVILVDDVLYSGRSVRSALDALRDVGRPRVVQLAVLVDRGHRELPLRADYVGKNVPTSRSESVHVLLAEHDGADGVVISR

SEQ ID NO: 4038 - protein, 377 aa, Mycobacterium paratuberculosis
MVWQRGELLQVNEIGYRDVEAGLPMRRDTLFRIASMTKPVTVAAVMSLVDAGKLSLKDPVTRWAPELAGVRVLDDPHGPLDRTHPLDRAILIEDLLTHTSGLAYGFSVSGPISKAYMRLPFQHGPDAWLAELAKLPLVHQPGEKVTYSHSIDLLGVIAARIEDKPFHQVLDERVLGPAGMTDTGFFVSPQARHRAATMYSLDEHSRLQHGVMGPPHVTPPAFCNAGGGLWSSADDYLRFVRMLLGDGTIDGVRVLSEESVRLMRTDRLTEAQKRHNFLGAPYWVGRGFGLNLSVVTDPARSTPLFGPGGVGTFSWPGAYGTWWQADPTAELILIYLIQNLPDLTVDAATAVAGNTSLAKLRTAQPRFVRTTYRALGL

SEQ ID NO: 4039 - protein, 179 aa, Mycobacterium paratuberculosis
MPEYPPDRITGPRLSLRLPVLDDAGPLFQRVARDPQVTKYLLWAPHPDVAATRRVITEKLNASADEKTWVIELRHRGEVVGLLSCRRTAPHSVEIGYCLGRRWWGKGLMSEVLGMLLTALDADREVYRVWATCSVDNQRSARLLEHAGFFLEGRLARHAVYPTMGPEPQDSLLYAKILR

SEQ ID NO: 4040 - protein, 906 aa, Mycobacterium paratuberculosis
MQIPDPTAPLRLDCDVLVIGGGTAGTMAALSAAEHGAQVLLLEKAHVRHSGALAMGMDGVNNAVIPGKAEPEDYVAEITRANDGIVNQRTIYQTATRGFAMVQRLERYGVKFEKNEHGEYAVRRVHRSGSYVLPMPEGKDVKKALYRVLRQRSMRERIRIENRLMPVRVLVDPDSGGRAVGAAALHTRTGEFVTVGAKAVILATGACGRLGLPASGYLYGTYENPTNAGDGYSMAYHAGAELSGIECFQVNPLIKDYNGPACAYVANPFGGYQVNAQGERFVDSDYWSGQMMAEVKREIDSARGPIYLKVSHLPDETLTALENILHTTERPTRGTFHANRGHDYRTHDIEMHISEIGLCSGHSASGVWVDEHARTTVPGLYAAGDLACVPHNYMIGAFVFGDLAGTHAASTLADVAVPQQLPADQLREAHELIYRPLRHPDGPPQPQVEYKLRRFVNDYVAPPKTAAKLSIAIRTFERMSAEIAEMGARNPHELMRAVEVSFIRDCAEMAARSSHTRTESRWGLYHDRADLPGRDDNQWGYHLNLRKGDDGRMVFLKRPVAPYFVPVPELDGLPPVDQTVHPVQQPPLIGGQAPASAVSRIASPATGFEPPSPRIAAVLALDEPSVAELAPYLGDPDPGVRRTAVATLTENTPEGYAPALLAALGDDAAAVRAAAAEGVRELVEVLSEPESVRAHLDSSDRVVRAAALYVLAARRAGDAARYRRALGDPDHRVRIEAVRALVSVDDVDGVVDAAGDENREVRIAAAAGLATLRDGTGPAGGAVRALVADPDPLVRAAGLAALGELGCGPDDYGAITQALRASAWQVREGAARALAGAAAEVAVPLLGEALGDAHLDVRKAAVLALTRWAGEPAARDALGIALKDTDADVRAYARRALEHPERAVKS

SEQ ID NO: 4041 - protein, 245 aa, Mycobacterium paratuberculosis
MTAMRLELDRVRLSYNGPAVINELSLVVRPGEILVLTGPSGCGKSTVLRALAGLLTPDGGRVLADGVPVTGTSGDRAMVFQDNALLPWRTVRSNIELALRLRGQPRAGRRAAAERWISELGLAGFGDYLPKSLSGGMRQRVQLARGLAGAPRAVMMDEPFGALDTRTRAAMQRLLIDTWRTHPTTIVFVTHDVDEALALGDRIVVLGRAGEPPRASVEVPEPRSDRPHAELRAQIIDALNHAEAA

SEQ ID NO: 4042 - protein, 286 aa, Mycobacterium paratuberculosis
MTAQVVADQVVGGVISAPPLARPRRGTLRWQSRVLRVVSVAAAIGLWQLLTADKVRLLLRFDTLPTVTEIVGALHRRLAAGEYWLDLAQSLLRILTGFGLAAVIGVATGVLLGRSRLFADVFGPLAELARPIPAIAMVPVAILLFPTDEAGIVFITFLAAYFPIMVSTRHAVRALPTLWEDSVRTLGGGRWQVLTQVVLPGILPGVFGGLSVGMGVAWICVISAEMISGRLGVGYRTWQDYTVLAYPQVFVGIITIGVLGFATSAAVELVGRRVTRWLPRAQDGAR

SEQ ID NO: 4043 - protein, 301 aa, Mycobacterium paratuberculosis
VGSAGHGTLVRALSRAGVNGVEVLNQQPQVGASALESGQVQALSQFVAWPGLLVFQGKAKLLYDGAELNLPTLHGVVVRRSYAAAHPEVLAAFLQAQLDATDFLNAHPLQAARIVADASGLPPEVVYLYNGPGGTSFDTTLKPSLTEALKSDVPYLKSIGDFADLDVDKFVVDEPLRAVFTARGLDYQAARARTTNPSTLRGDPALAGELWLDGADTTQTTADPASLLRAVRDALGRGARVRAAYVPDTEFGTRWFADKAFWVKDGQNYLPFGTAAGAGRYLAAHPGGIAVNYQQALGGSV

SEQ ID NO: 4044 - protein, 173 aa, Mycobacterium paratuberculosis
MRRHAALLASVLIAVAALGTGCSLESLSQSAGVVNVVVGYQSKTINTVTAGTLLRAQGYLERRLADITTRTGTKYAVRWQDYDTGAPITAQMLAEKIDIGSMGDYPMLINGSKTQANPLARTEMVSITGYNPKGALNMVVVSPDSRARTWPTWPAPRSRPAWARPATAPWCGP

SEQ ID NO: 4045 - protein, 76 aa, Mycobacterium paratuberculosis
MTLIHNTRVDVPVTIDESLCIEGCTLCVEVCPLDALAIDPDTGKAYMHVDECWYCGPCAARCPTGAVTVNMPYLLR

SEQ ID NO: 4046 - protein, 314 aa, Mycobacterium paratuberculosis
VTGPAVLLIRITNPPGGRGWRNDPARRGFGWSGPNATRRNAVGRRLRPRSPARKTPLSCVSVTVVAHPVPIGGPRADRARRVADVLRQQIHADAYPDGLPAELELADEFSVSRNTIREALAVLKREGLIDRGPRVGTHVAQRKYDHALDALLGLKETFKDLGEVRNEVRAAMPVTAPPSVARRLRLAPGEQAVFIERLRYLGELPLSLDLTYLAPAIGRQVLEHSLETNDVFALIEQVSGQRLGSAALALEAIPADAHSAATLQVPDGAALLMLERLTSLADGTPVDLEYIRMRGDRITMRGNLFRAEPMRSNS

SEQ ID NO: 4047 - protein, 268 aa, Mycobacterium paratuberculosis
MSAADGVSSQTWTKVPAITLGFWVIKVLATTLGETGGDTVTMTLDWGYAAGVALFGVTLVLLVAAQILAARFHPVLYWATIVASTTFGTVLADFADRSLGIGYTGGSLLLLACLLATLGLWRWSQGTVSVATVHTPKVEAFYWATITFSQTLGTALGDWLADTRDFGYRRGALVFAAGLLVVAGLYFWTGVSRVALFWVAFILTRPLGATVGDFIDKPVAQGGLAWSRPLATAVLAALIAVLLIVIPQRPGRHPGRPEAGAAQSPTAT

SEQ ID NO: 4048 - protein, 108 aa, Mycobacterium paratuberculosis
MPPVPRQRVGAPLMMLPPMGLREQPIHECPTMWFNRDFFESPWPGWTVDVDLTRPTTFVSHTDPGETLRGHPVRIRLEDPGVLWVATNRFARMGGPFAEVLIEARWPD

SEQ ID NO: 4049 - protein, 222 aa, Mycobacterium paratuberculosis
MKVLLVEDEPRLAATVARGLKAEGFVVVTVGNGVDGLAEATENPFDIVILDIMLPGRSGYEVLRRMRSNNVWTPVLMLTAKDGEYDETDAFDLGADDYLTKPFSFRVLVARLRALVRRGAPERPVVLTAGSLSLDPARHTVQRGSTPIALTPREYGVLEFLMRNKDVVVTKADILANVWDAHHHGPDNVVEVYVGYLRRKIDVPFGTNTIETIRGVGYRLLC

SEQ ID NO: 4050 - protein, 467 aa, Mycobacterium paratuberculosis
VFSGGARACRIEGVHLGISARSAAVAAIVVFCALTVAGAGLDAILYRSLLSGVDYAAAERVRDIAKALQSDSREELDNALLTTDQRVVATQLIGPDGSVVKRSGSAPATPLVPTADFDFTLRRGLPDDAVSGDDMRVSGQKVATRSGVYTVLVGGGSEAVEATARTLAILLATTAPVIVAVAAGATYWLVRRSLKSVDAIRARVADISASDLAERVPVPDGRDEIAALAVTMNEMLSRLEAGHRAQQRFVGDASHELRSPLTTIISGLEVAEAHPELLDAELAVNTLLPEAHRMRALIDDLLLLARADERNLLRRKEPVALDDLAEAEAARVRRDADCAVHTDIRPARLLADPTAMTRMIRNLVDNAVRHAVSCVAIEVGSRDGTAVLTVGDDGPGIPPAQRSRVFERFVRLDTDRARSGGGAGLGLAIVAEVVAAHGGTVTIGDRPGGGTTLTVALPQHPAQHSSR

SEQ ID NO: 4051 - protein, 94 aa, Mycobacterium paratuberculosis
MVGTARPPRGEHRAMARMLVAAVVAVGSGVLVAAPAGADPSPFGTLSSSCRDQAAAGRDALIQGIHRGVADWPVSAPHTSARTTCPAGPTPATG

SEQ ID NO: 4052 - protein, 950 aa, Mycobacterium paratuberculosis
MIRYSTQPRRLRVSALAAVANPSYARVDTWNLLDDACRHLAEVDLAGLDKTHDVARVKRLLDRIAAYERYWLYPGAENLAIFRAHLDSLSTVRLTEEVSLAVRLLSEYGDRAGLFDTSAPLDDQELVAQAKQQHFYTVLLADDAPSTAPDSLAECLRALRNPSDDVQFEILVVPSVEDAITAVALNGEIQAAIIRDDLPLRSRDRLPLMNTLLGPNEDADGVIPDRANDWVECGEWIRELRPHIDLYLLTDESIAAGDDTEPDVYDRTFYRLNDVTDLHSTVLAGLRNRYATPFFDALRAYAAAPVGQFHALPVARGASIFNSRSLQDMGEFYGRNIFMAETSTTSGGLDSLLDPHGNIKKAMDKAAKTWNADHTYFVTNGTSTANKIVVQSLTRPGDIVLIDRNCHKSHHYGLVLAGAYPLYLDAYPLPQFAIYGAVSLRTIKQTLLDLEAAGQLHRVRMLLLTNCTFDGVVYNPLQVMQEVLAIKPDICFLWDEAWYAFATAVPWARQRTAMVAAERLEQMLASPDYVEQYRKWAASMQGVDRSEWIERELLPDPATARVRVYATHSTHKSLSALRQASMIHVRDQDFNALTRDAFGEAFLTHTSTSPNQQLLASLDLARRQVDIEGFQLVRQVYDMALVFRHRVRKDRLISKWFRILDESDLVPEEFRASSVSSYREVRQGALAEWNEAWRSDQFVLDATRVTLFVGATGMNGYDFREKILMERFGIQINKTSINSVLLIFTIGVTWSSVHYLLDVLRRVATDFDRIQKEASAADRALQRRHVEEITEDLPHLPDFSEFDVAFRPVDECNFGDMRSAFYAGYEESDREHVLIGTAGRRLAEGKNLVSTTFVVPYPPGFPVLVPGQVVSKEIVYFLAQLDVKEIHGYNPDLGLSVFTDTALARMEAQRNAATAAVGSVTAAFELPADASGGNGAHNGAGAVPSVADGG

SEQ ID NO: 4053 - protein, 129 aa, Mycobacterium paratuberculosis
VTRLELRLVVAAVLAATVVVGAVVCAAYHLSIVASVLAIHALGVGAWLYHCVERVAVARRISTVRSAATPLRPLLPVMAAIMGLTQGVVRSLSDVTELPVRRWELPVLRWVDGGRGNRRVIDGDDEPDR

SEQ ID NO: 4054 - protein, 156 aa, Mycobacterium paratuberculosis
VSKPLRGRHQARKRAVDLLFEAEARGLSPAEVVDVRTGLADTNPEVAPLQPYTAAVARGVGDHAAHIDDLISSHLQGWTLDRLPAVDRAILRVAVWELLYADDVPEPVAVDEAVQLAKELSTDDSPGFVNGVLGQVMLVTPQIRAAARAVRGPRDT

SEQ ID NO: 4055 - protein, 187 aa, Mycobacterium paratuberculosis
VASTADFKNGLVLVIDGQLWQIVEFQHVKPGKGPAFVRTKLKNVLSGKVVDKTYNAGVKVETATVDRRDTTYLYRDGSDFVFMDSQDYEQHPLPESLVGDAARFLLEGMPVQVAFHNGSPLYIELPVSVEMEVTHTEPGLQGDRSSAGTKPATVETGAEIQVPLFINTGDKLKVDTRDGSYLGRVNA

SEQ ID NO: 4056 - protein, 369 aa, Mycobacterium paratuberculosis
VTHSQRRDRLRARLEADGLDALLVTDLINVRYLSGFTGSNGALLVFADDRPPVLATDGRYRTQAAEQAPDLDVAIERALGRYLAGRAAEAGARTLGFESNVVTVDGFDALTGELDGRKAATELVKAAGTVEALREVKDAGEVALLRLACEAADAALTALVDGGGLRPGRTEREVSRELEALMLDHGADGISFETIVATGANSAIPHHRPTDAVLADGDFVKIDFGALVGGYHSDMTRTFVLTKAADWQLEIYRLVADAQRAGREALRAGADLREVDAAARRVIADAGYGEQFSHSLGHGVGLEIHEAPGIGATSTGTLRAESVVTVEPGVYLPGRGGVRIEDTLVVPPETAGKPPELLTRFPKELAVLA

SEQ ID NO: 4057 - protein, 223 aa, Mycobacterium paratuberculosis
MSNWMLRGLVYAAAMVVVRLFQGALINAWQTQAGLFSVVLLLLFVIAVAVWGVFDGRADAIANPDPDRRGDLAMTWLLAGLVAGVLSGAVSWLIALVYKGLYTGGLINEVTTFAAFTALCVFLPGIIGVTIGRWRVDRNPPPRRPGHDDERADTDVFSAVRGDDAPTGEIPAAGAQTEAHTAAVATAEREAESPTETIPSAGDDPKTEVIRTEPEPGGEPGKA

SEQ ID NO: 4058 - protein, 143 aa, Mycobacterium paratuberculosis
MIVQVINGPNLGRLGRREPDVYGDTTHDQLAALIEAEAAALGLKAIVRQSDSEAELLDWIHGAADANQPVILNAGGLTHTSVALRDACAELSAPLIEVHISNVHAREEFRRHSYLSPVATGAIVGLGVQGYLLALRYLAGRPA

SEQ ID NO: 4059 - protein, 365 aa, Mycobacterium paratuberculosis
MRTTREPVTVQVAVDPPYPVIIGTGLLGELDELLGARHKVAVVHQPVLAETAEVIRKRLADKGVDAHRIEIPDAEDGKDLPVVGFLWEVLGRIGIGRKDALVSLGGGAATDVAGFAAATWLRGVDIVHVPTTLLGMVDAAVGGKTGINTDAGKNLVGAFHQPLAVLVDLATLHTLPPNELVAGMAEVVKAGFIADPAILDLIEADPRAAVDPSGEVLAELVQRAIAVKADVVAADEKESELREILNYGHTLGHAIERRERYRWRHGAAVSVGLVFAAELARLAGRLDDATARRHRTILSALGLPVSYDADALPQLLEYMAGDKKSRAGVLRFVVLDGLAKPGRLAGPDPSLLAAAYAALADEDAS

SEQ ID NO: 4060 - protein, 176 aa, Mycobacterium paratuberculosis
MAPKAVLIGLPGSGKSTIGRRLAKALGVGFLDTDAAIEQRTGRPIAEIFATDGEREFRRIEEEVVRAALTEHDGVLSLGGGAVTSPGVREALAGHTVVYLEISATEGVRRTGGNTVRPLLAGPDRAEKYRALLAERSPLYRRAATIRVDTNRRNPGAVVRYIVSRLPATDACRAAT

SEQ ID NO: 4061 - protein, 404 aa, Mycobacterium paratuberculosis
MGPVLRWITAGESHGRALVAVLEGMVAGVEITSTDISEQLARRRLGYGRGARMSFERDAVSVLSGVRHGLTLGGPIAVEIGNTEWPKWETVMATDPVDPAQLADSARNAPLTRPRPGHADYAGMLKYGFDDARPVLERASARETAARVAAGTIARSFLRQALGVEVLSHVIAIGPSAPYEGPPPGPGDLPAIDASPVRAYDEAAEQAMIAEIEAAKKDGDTLGGVVEVVALGLPVGLGSFTSGDNRLDGQLAAAVMGIQAIKGVEIGDGFATARRRGSQAHDEMYPGPDGVVRSTNRAGGLEGGMTNGQPLRVRAAMKPISTVPRALATVDMATGDEAVAIHQRSDVCAVPAAGVVVEAMVALVLARATLQKFGGDSLAETRRNIDAYRRAVAEREAPAARGTA

SEQ ID NO: 4062 - protein, 535 aa, Mycobacterium paratuberculosis
MGPPLLDVSGLTVTYPGAVPRVALDRVDLAVSSGEFVAVVGESGSGKTTLANAVAGLLPAAARITAGSLTIAGRDVLGLSERQWCRLRGSTVGLVPQDPATSLNPVRSIGSQIAEIFPLKGERLSRREARRRCIELLDRVEIDRPAQRLKQYPGELSGGMRQRVLIAIAFALNPGLLIADEPTSALDVTVQRHVLAVFDRLVAEQRTTVVFITHDIGVATDHASRIVVMRGGVVVEDAPAEAIVAAPRTEYAAHLVRRLTAPAPAAAPAGSEDVIEVAGVAKEFRLGARARHTAVAEVAFTVRRGETLALVGESGSGKSTTAKMVVGLLTPTRGTVRVLGRDVAALPARPRRRHWQDIQFVYQNPGSALDPRWTVRQILDGPLRSYRVHDRARRAQRIAEALASVGLSDDKLDRRPGELSGGECQRVAIARALVLRPQIVVLDEPLSALDVVTQDQIVGLLLRLQRQLGLTYLFVSHDLSVVRRLAHRVVVLRAGRVVETGDTAAVFAAPAADYTRALLDAVPGRRLAHPALSPS

SEQ ID NO: 4063 - protein, 268 aa, Mycobacterium paratuberculosis
MSARRASWPVRISAAVLILTAAWAAAPGLFTDRNPLKGRPVDKFQPPSAAHWFGTDHLGRDVLTRVIYGTSHTVATAGLAVAVGLLLGSAVGIAAGVSGPVVDAVAMRASDVLLALPGFLTSVWIVTAYGPGPLSVGIGVGIGSIAVFARVFRAEVLRVRALDYVEAAFLSGETRWSVIRRHIVPNAAGAVIALAVIDLSGAILLISALGYLGYSAPPPTPEWGLLVAEGRRYLATAWWLSTLPGAVVLSVILALGVLSRRALTSHRI

SEQ ID NO: 4064 - protein, 171 aa, Mycobacterium paratuberculosis
LVVLQVFSVQLGLISLFPDGSVTSLLVAALVLAVPVSAPIAQVLGKNIDATLALPHVNTARAKGGTPGWVIRKHVVKNAAGPALTVTATTVGALLGGSVVTETVFSRSGVGAVLLQAVSSQDISLIQGLVLLTAVAIVTANLAVDLIHPLLDPRVTRVQRRGFTTRLGRFG

SEQ ID NO: 4065 - protein, 146 aa, Mycobacterium paratuberculosis
MLGYVLARIGQSAIVLLAVFSLVFWGVSILPADPAAIFVAKGEGYFNPDIVAQVKAFYGYDRPLWVQYFAQLNQVLHGHFGFSLSSGQAVTDRIGGVIGETLKLAATATGFAVLFAVSVTALATTCAPVRSVLRAIPPLFGAVPTF

SEQ ID NO: 4066 - protein, 530 aa, Mycobacterium paratuberculosis
MAKVATRTATLGAVLCVLAAGCSGHRHTASTGPTGPPVRGGTLTYSDVQFVTDTMAANYSANNLMFQLLDRVVYVDPKTDAVRGWLAKTFSRNQNATRYTFTIRDGVSFSDHTPLTAEVVKANFDQLGKGDPAKKMPAFADFVGYDHSEVSGNVVTVFLDRPNTNFYKVLSYSRAGIRAPATLALDYQRQAKVENVIGSGPFVYQSQIPDQQVVLTRRPDYAWPPSSWPNQGPAYVDKVVFRVIGEPGLRAGAVQSHQVDVARGIQPTDEPALKQGGLQVIPVAAPAETANLVGFRINNQVVDDVRVRRALQLGIDRRAVVDTVLSDSYRAADSVLGHDDPLFADVSADIGYQPQRAAGLLDAAGWKPGGDGVREKDGKKLVLTLAASNQSVVFRPAFEFIEQQWRELGVVLQNRAGDTTFFNASSSQSSTPLFGTRIQYNIGLGLLFGRPKSNLTFAQNDALLALSEEELRQTDPTRLKDVVAREQRRIIDDQLALVLWDEVQVHAAAPNVHVEFTRYTEPLLQSAWKA

SEQ ID NO: 4067 - protein, 406 aa, Mycobacterium paratuberculosis
LTRMPVAFHRQDTPAGAAAVQPVLAEIAADYRLRLADGGTEPPLRGLKLVRDHRLGALRLARELGGAGYTAPEFFDYLVALAAADPDLAHILRIHYALVEELQVTPRRPGSDRWIAVVAEGGLIGGANAEQSQKSVGGNHRDTRLVTTPDGLRLRGRKFYSTGAQFSDYLRITAQDDDGAPTAVVIPVDRAGVEHLDDWDGIGQRQTGSGTTVFNDVAVADDEVFPLGSTIGVNRARGALVQLYLHAVAAGILRSLTEDAAALVRGRRRTYTFASADTPTADPQLLQIVGEIDAVAYTAHALVRNAAAELAPALQAARDTGIDPELEAAASIAAARVKVAIQEPALRAASRVFDAGGASAVQASALLDRHWRNLRTLFSHNPTVYKARVLGDVAVNGAALPDTSFF

SEQ ID NO: 4068 - protein, 320 aa, Mycobacterium paratuberculosis
LHRAGGHVASWFMAVALSVGIELAGDGIGERSPASGIAGLPHRLESAGVHYWVIGADRAEPPAAPSLDASVIATVAARHSSHLGLVVAAAPHRDHPYNLARRLVSVDHAARGRVGWFALDADRRIALGAGADTWTGAALGPPHTAEAIAAVRTLWRTWPFASVLGDRPTGVFADTTRLRRADVRGAYRIAGPLNVPGSRQGDLPVWQHAGAATADADVVVVEDGAPVPDGAVVRVRSVDHAALERVAGTTGAAGVLLRVPADALTAVLDDVVAAAYRRGLLATPGAGTLRQRLSLPVPAAPDLSHHPRAFDDAPNAGARL

SEQ ID NO: 4069 - protein, 413 aa, Mycobacterium paratuberculosis
VLNLGIHTASWRRSAEPPTAFTDPGYYVRMARIAERGTLDALFLADGPAVRDHPALRPSQALEPSVILAAVAAETEHLGLIGTFSSTFNDPVELAHRLLSLDQLSGGRLAWNVVTTYSEAAGGNFGLADLPDRSTRYRRAAEFVDVVLALWRDAATGGGVDHRGEFFAVTGSLPQSPSPQGHPLLVQAGGSPQGRELAGRVADAVFSAELDLDAAIEHYRYVKDAAAAHGRGRDAVRILPGLITTIGSSRAEAQRRYEEQNALLPAGHDVERLSQTLGADLSGLPLDEPIPARLLGSVPDPSKFVGSLGFRESVVRLVVSGGLTLRQTLRAFSGSGHRVIVGSPVDVADTIEQWFGAGAADGFNLMPDVFPDGLEVFVDEVVPILRSRGLFRASYAEATLRERLTGDRHVVAA

SEQ ID NO: 4070 - protein, 301 aa, Mycobacterium paratuberculosis
TFTVATAIAARTTAFAPLVAVRPGYWHPAHFASAAATLDRLNGGRLLVNIVSGADDVAAYGDTEVDKSRRYDRTREFIRLLRRLWTQDDVTFHGEFFRVEHSTLRPRPLGAEQGRHPKLYFGGASPAAEQVAATDADVQLFWGESLDGIAERIDRLKALSDRLGREHPPLEFGLRVTTLVRDTSEEAWRDAEAKVAKLAGTPTMMLLHDPAGSEGQRRLNDLAARGEVIDSCLYTTPSKYGGEGAGTTWLVGSAAEVAAALRAYADLGVSHFVLSDTPYQSEVVRLGDQLLPLLRHTALAN

SEQ ID NO: 4071 - protein, 142 aa, Mycobacterium paratuberculosis
MRIAAAGAVLTWLAVLSCYDIRQHRLPNALTLTGAAAILAAAGLAGRGPSALAGAAALAAIYLLVHAVAPGGMGAGDVKLALGVGALTGCGGVGVWFLAALAAPLLTVLVGVLARVRRAGPTVPHGPSLCLAAAAGAGLALF

SEQ ID NO: 4072 - protein, 276 aa, Mycobacterium paratuberculosis
VSSTAPPASAGPRRAAVLGKPIGHSKSPQLHLAAYRALGLHDWTYERIECDADQLPGVVGGFGPEWVGVSVTMPGKFAALRFADERTEQARRVGSANTLVRTATGWRADNTDIDGVAGALGAASGWALVCGSGGTAPAAVAGLAQLGVAGITVVARNPDKAARLVRLGDELGVPTRFCALDGAGLADEVAAAEVLVSTLPAEVAERYAGTLARVGVLLDAVYDPWPTPLAAAVSAAGGRVISGMQMLLHQAFAQVEQFTGLPAPREAMTCAAADAD

SEQ ID NO: 4073 - protein, 415 aa, Mycobacterium paratuberculosis
MVDSARRERAEPEAVGPPRRRSSRMARNRAERGRRRRRFALRAALALLVVVVLAGVFAGGKLWHTVFGPGDDYSGSGKRDLVIQIQAGDSTTMVGETLHNQHVVKTVRAFVNAAHGNSKIDSIQPGFYRMRTEIPASDAVARLADPNSRVGRLVIPEGRQLDDTTDMKTNKVNPGIFTLISQATCVDLDGNRRCVPVQQLRAAATNSTTAALSVPPWALEPVNELGRDHRRIEGLIAPGTFNVDPSASPESILAGLISAGAEEYLKSGLVDTAQAMGLSPYDILVVASLVQQESNTPDFAKVAQVIYNRLHAHHTLEFDSTVNYPLDRREVATSDADRGQKTPWNTYVSQGLPATAICSPGIDALHAAEHPAPGDWLYFVTIDAAGTTLFTKDYQQHLANIELAKHNGVLDSTPR

SEQ ID NO: 4074 - protein, 167 aa, Mycobacterium paratuberculosis
VVLTQHRVPDRPGDPDQDPGRGRRLGIDVGSVRIGVACSDPDAVLATPVETVRRDRSGKHLRRLAALVTELGAVEVVVGLPRTLADRTGTSALDAIDLADQLARRIAPTPVRLADERLTTVAAQRSLRAAGVRAKEQRAVIDQAAAVAILQSWLDQRRAATREAGDG

SEQ ID NO: 4075 - protein, 900 aa, Mycobacterium paratuberculosis
VQTHEIRKRFLDHFVKAGHTEVPSASVILDDPNLLFVNAGMVQFVPYFLGARTPPYPTATSIQKCIRTPDIDEVGITTRHNTFFQMAGNFSFGDYFKREAIELAWTLLTGSVEQGGYGLDPERIWTTVYFDDDEAVRLWQEIAGLPAERIQRRGMEDNYWSMGIPGPCGPSSEIYYDRGEEFGVGGGPIANEDRYVELWNLVFMQSERGEGTSKTDFEILGPLPRKNIDTGMGVERVAFVLQGVHNVYETDLLRPVIDAVAARAPRPYDAGNHDDDVRYRIIADHSRTAAILIGDGVTPGNDGRGYVLRRLLRRVIRSARLLDIEGPIVGDLMATVRDAMGPSYPELVTDFDRIARIAVAEETAFNRTLAAGSKLFDEVASTTKATGAKSISGSDAFTLHDTYGFPIELTLEMASEAGLQVDEVGFRELMAEQRRRAKADAAARKHAHADLTAYRELVDAGPTEFTGFDELSSEARILGIFVDGKRVPVVTHGGDGADRVELVLDRTPLYAESGGQIADEGTISGTGAGESARAAVTDVQKIAKTLWVHRVNVESGEFVEGDTVIAAVDPQWRRGATQGHSGTHMVHAALRQVLGPNAVQAGSLNRPGYLRFDFNWQGPLTEEQRTQIEEVTNQAVQADFEVHTFTEQLEKAKAMGAIALFGESYPEQVRVVEIGGPFSLELCGGTHVHNSAQIGPVTILGESSVGSGVRRVEAYVGLDSFRHLAKERALMAGLASSLKVPSEEVPARVANLVERLRAAEKELERMRLASARAAAGNAAAGAERIGNVRVVAQRMSGGMTAADLRSLVGDIRGKLGSDPAVVALIAEGEGGSVPYAVAANPAAQDLGIRANDLVKQLAAPVDGRGGGKADLAQGSGKDPAGIDAALDAVRSEIAAIARVG

SEQ ID NO: 4076 - protein, 133 aa, Mycobacterium paratuberculosis
MHTDVLDVDTSRRRIVDLTEAVRGFCWSRGDGLCNVFVPHATAGVAVIEMGAGSDDDLVDTLERLLPRDDRYRHAHGSPGHGADHVLPALVAPSVTVPVSAGEPMLGTWQSIVLVDLNRDNPQRSVRLSFLEG

SEQ ID NO: 4077 - protein, 110 aa, Mycobacterium paratuberculosis
EEGNWWDRWRHRGATPTRKGSTVYARSTTIQAQPLSIDIGIAHARDVVMPALTEIDGCVGLSLLVDRQSGTCIATSSWESIDAMRGSAARVAPIRDRAALMFDGSARVEE

SEQ ID NO: 4078 - protein, 102 aa, Mycobacterium paratuberculosis
VRATWLKVVPDQLSRSLEFYRSSVLPELEQLDGFCSASLMVDHPACRRAVACSTFDSMDAMARNRDRATELRSRRVRELGAEVIDVAEFELAIAHLRVPELV

SEQ ID NO: 4079 - protein, 115 aa, Mycobacterium paratuberculosis
EGTVMKVFTDEEMGRLLTTAKPYSVVILKRGPGFGHESAAGVIWEHGRRNFGLRDDGVLAVVLPVSDGSDVCGVGVFAATVDETTRIMSEDPGVAAGVFSYEVHACRGFPGDALP

SEQ ID NO: 4080 - protein, 450 aa, Mycobacterium paratuberculosis
MPEAVSDGLFDLPGAPPPGDHGLGVPAGAPLAVRMRPASLDEVVGQDHLLAPGSPLRRLVEGSGVASAILYGPPGSGKTTLAALISQATGRRFEALSALSAGVKDVRAVIESARTALLRGEQTVLFIDEVHRFSKTQQDALLSAVENRVVLLVAATTENPSFSVVAPLLSRSLILQLRPLSADDIRTVVRRAIDDPRGLGGRVPVAPEAVDLLVRLAAGDARRALTALEVAAEAGESVTVQTVEQSLDEAAVRYDRDGDQHYDVISAFIKSVRGSDVDAALHYLARMLVAGEDPRFIARRLMILASEDIGMADPAALQVAVAAAQTVALIGMPEAQLTLAHCTVYLATAPKSNAVTTALGAAMSDIKAGKAGLVPAHLRDGHYSGAAALGHAQGYQYSHDHPDGVVAQQYPPDELVGVDYYRPTGRGAEREMAGRLDRLRAIIRNKRGRS

SEQ ID NO: 4081 - protein, 319 aa, Mycobacterium paratuberculosis
MSQPPEYPGTPPEPPPGYGPPPGYGTPPGYGTPPPPPPGYGPPPGYGAPPPGYGPPPGYGPPPGFGGPPKPAFSVGEAFGWAWNAFTKNPVALIVPTLVYLVVLGGASTLIGLSQDVGTSGGGSGDDYFTFTPNLNGGGMALLVLGYLVAYLVGAFAQSAYLSGCLDLADGRPVTIGSFFKPRNFGMVFLAALLVGILTSVASALCFLPGLILGLFAQFTIPYAIDRSESAVKALSSSFSTVTANFANALLVWLAEFALVVVGAVACGVGLLLAAPVAALVGIYAYRKLSGGQVAPPPGYQPGPPPGYQPGPPPGAPPA

SEQ ID NO: 4082 - protein, 887 aa, Mycobacterium paratuberculosis
MGFADKTFGTGGPSAAAGGSYDADRLLAGYRAARAQQALFDLRQGPASGYDEFVGPDGKVRPAWTELADAIGERGRAGLDRLRSVVRGLIDHDGITYTDVEPGGRGQEPRPWQLDTLPIVLSAADWEPLEAGLLQRSRVLDAVLADLYGPRSLLTEGVLPPELLFGHPGYLRAANGIEIPGRHQLFMHACDVSRRPDGGFAVNADRTQAPSGAGYALADRRVVAHAIPDLYERIAPRPTTPFAQALRLALIDAAPDVAQDPVVVVLSPGIYSETAFDQAYLATLLGFPLVESADLVVRDGMVWMRSLGTLKRVDVVLRRVDAEYCDPLDLRADSRLGVAGLVEAQHRGTVTVVNTLGSGILENPGLQRFLPAMARHLLSETLLLPSAPVYWGGIDTERSHLLANLASLLVKSTVGGKTLVGPALSSLQLAQLAARIETAPWQWIGQELPQFSSAPTDHAGVLSSAGVGIRLFTVAQRGGYAPMIGGIGYLLAAGPAAYTLKSVAAKDVWVRPTERARAEAVGVPAVEPPAKTAAGTWAVSSPRVLSELFWIGRYGERAESMARLLIVTRDRFHVYRHHQHSEESECVPVLMAALGRITGTDTGTGAAAGGDAAETIAVAPSTLWSLTVDPQRPGSLVQSVEGLALAARAVRDQMSNDTWMVLAGVERALALDSEPPDSLAEADALLTAAQTQTLAGMLTLSGVAGESMVRDVGWTMMDIGKRIERGLWLTALLRATLAVVRGAAAEQTILESTLVACESSVSYRRRTAGKVSVAAMAELMLFDAQNPRSLLYQVERLRADLKDLPGASGSSRPERLVDEIGTRLRRSHPAELERISDDGRRTELAELLDSVHAELRSLAEVLTTTQLALPGGMQPLWGPDVRRVMPA

SEQ ID NO: 4083 - protein, 340 aa, Mycobacterium paratuberculosis
MRDFTCPKCGQRLTFENSTCLNCGSALGFSIEQMALLVISEDETSGHAGFVPASEYQLCANLLLAECNWLVPVNEPRLLCASCVLTTERPNDADSVGLAEFARAEAAKRRLIAELHELRLPIVGRDQDPDYGLAFRLLSSAHENVLTGHQNGVITLDLAEGDDVHREQLRVEMDEPYRTLLGHFRHEIGHYYFYRLIAPHPDHLRRFNELFGDPDADYQQALDRHYSEGAPEGWQENFVSSYATMHASEDWAETFAHYLHIRDTLDTSAWCGLAPASATIDRPALGPSAFQTIIDTWLPLSWSLNMVNRSMGHDDLYPFVLPAAVLEKMQFIHAVVDGAG

SEQ ID NO: 4084 - protein, 311 aa, Mycobacterium paratuberculosis
VISLVPEADQQADGGAARRHRVTHRTEYRYSDVVTSSYGRGFLTPRDSLRQRCVAHRLTIDPAPADSSTSTDCYGNISSYFHVTEPHHSLTVTSDSIVDVNPPAPGLYTTGPAVQPWEAARPAGRRGALATEFTLDLDPPEITDEVRDYAAPSFAPGRPLIEVLRDLASRIFTDSTYRSGSTTISTGVAEVLAAREGVCQDFARLAIACLRAHGLAASYVSGYLATDPPPGKDRMIGIDATHAWAAVWTPHEPGQFEWLGVDPTNDQMIDERYIVVGRGRDYADVPPLRGIIYTNSQHSVIDVSVDVVPYA

SEQ ID NO: 4085 - protein, 129 aa, Mycobacterium paratuberculosis
VATWYDVARIVGELALTSEPSPHDWRVGKKLLAWERPLRPSEREALARTGAEPAPGNVLGVRVADEGVKFALIDDAPQTFFTTPHFDGYPAVLVNLDAISVRDLEELITEAWLTQAPRKLVQEFLADSR

SEQ ID NO: 4086 - protein, 352 aa, Mycobacterium paratuberculosis
MRGSAVPSLVRTAVRAGGKRLGAVWFNLLQTSLAAGLSWYLAHDVLDHPQPFFAPIAAAVSLSTSNVLRAQRAVQMMIGVTLGIGLGTVVQGMLGPGALPIAVAAPVALGAAVFIGGGFIGHGMMFANQTVVSALLVLALYRGGAGPERIFDALIGGAVAIVVAVLLFPADPRTVLGAARAGVLAVLHDVLSRAADVSSGRRAAPPDWPLSAVDRVHEQLSGLLEARTTAWHVVAIAPRRWGLRDAVRAADHQAVHVALLAGSVLQLARAVAPGPGDRQGQPVSTVLLVLAAATALADRDPAGACVYLGSARRHAARLRSGDGGDREPHVALADAVGACVDDLQRVIDLRPG

SEQ ID NO: 4087 - protein, 143 aa, Mycobacterium paratuberculosis
MTDIPDTGTINAFNQSIIDEFRANDGKVGGQFEGADLLLLHTTGAKSGQPRVSPLAYFRIDGKLLVIGSFAGAPVSPAWVHNLRANPAARVEIGTDSFDVTARELPREERDALFAQVAAAASGFAEYQAKTSRVIPLFELIRT

SEQ ID NO: 4088 - protein, 160 aa, Mycobacterium paratuberculosis
LPKIGADLENIAASLAEAQKTAAGQIAALESRLQQLDGFIGQAVEMEKDPKLTAEDRHALDAFITAREDDAIRDTKAALGQLQATRDGYSSSFQNALGTLHADGYDSTGVQAGTVPAPVDHPGGGPALTPTTGDCGNRGCGCGRRWYRRRCASGYDQLDR

SEQ ID NO: 4089 - protein, 154 aa, Mycobacterium paratuberculosis
MQLRYISIPALIAEAGGDPWAVDRSLQAGSPFRISQLAEAFHAAGRCTAEANHSFEQARDRFDAAWNHQDGDHPINDSAEVQRVTKSLGGAISSVAQDRCGPGKHRREPGRGAKNRGGADRSVGKSAAATGWLHRPSGRDGKRSQTHCRRSTCA

SEQ ID NO: 4090 - protein, 591 aa, Mycobacterium paratuberculosis
VLRSHAAGSLRSSDAGQQVTLAGWVARRRDHGGVIFIDLRDASGITQVVFRDPDVLKQAHRLRAEFCVAVTGLVEIRPEGNANPEIATGDIEVNASSLTVLGESAPLPFQLDEPAGEELRLKYRYLDLRRDAPASAIRLRSKVNAAAREVLDRHDFVEIETPTITRSTPEGARDFLVPARLHPGSFYALPQSPQLFKQLLMVAGMERYYQIARCYRDEDFRADRQPEFTQLDMEMSFVDAEDVIAISEEILAALWALIGYDIPRPIPRISYADAMARYGSDKPDLRFGLELVECSEFFKDTTFRVFQAPYVGAVVMPGGASQPRRTLDGWQEWAKQRGAKGLAYVLVGEDGELGGPVAKNLSEAERAGLAGHVGAAPGDCIFFAAGPAKPSRALLGAARSEIAHRLGLIDPQAWAFVWVVDPPLFEPADDATAAGDVAVGSGAWTAVHHAFTAPKPGYEDAIETDTGNVLADAYDIVCNGNEIGGGSIRIHRRDIQERVFAVMGLDHAEAQEKFGFLLEAFTFGAPPHGGIAFGWDRINALLSRVDSIREVIAFPKTGGGVDPLTDAPAPITEQQRKESGIDVKPEPSKPH

SEQ ID NO: 4091 - protein, 255 aa, Mycobacterium paratuberculosis
LRPDDADPIVVPGPVHTDPGRVSGPVDVVLLAVKATQNAGAAGWLARLCGEHTVVVVLQNGVEQVEQVRPLCPVSPVTPGIVWYSATTQPQGWVRLRTEPALVLPSGPSAQAVAALLRDAGCRVDCDPDIITAAWHKLLTNALAGFMALSRRRSGMFRRDDVAALSRRYVAECLAVARAEGARLSDDVVDELVDLFRRAPEDMGTSILSDAEAHRPMEWDVRNGVIARKGRAHGLPTPISDVLVPLLAAASDGPG

SEQ ID NO: 4092 - protein, 165 aa, Mycobacterium paratuberculosis
MFDCERVGLDFIDSAPVVFRNSVDLAITPEQLFEVLSDAAAWPRWATVITKVTWTSPEPRGVGTTRVVEMRGGIVGNEEFLAWEPFTHMAFRFNECSTRSVAAFAEDYRVQVIPGGCRLTWTMAQKPAGPAKLAMAVVGPLLNLALRRFLRNLRSYTDSLATRQP

SEQ ID NO: 4093 - protein, 292 aa, Mycobacterium paratuberculosis
MTFNEGMQIDTSTASSSGGGGMGMAVGGGGLGLIILLGALFLGVDPGRVMPQQQTNTGGYSAPGFDLSQCKTGADANKYVQCRVVATGNSVDAVWHQLMPRYTRPHVRLFTGRVNTGCGPATTAVGPFYCPVDQTAYFDTDFFQELVDRFGSSGGPFAQEYVVAHEYGHHVQNLQGVLGRSQQGAQGAGGNGVRTELQADCYAGIWAHYASTVKQESTGVPYLEPLSDKDIADALSAAASVGDDRIQKQATGRVNPESWTHGSSEQRQKWFTIGYQTGDPKQCDTFSAPDLG

SEQ ID NO: 4094 - protein, 291 aa, Mycobacterium paratuberculosis
LTEPKIHGIIAYPVTPFADNGIDTERLAALVERVVSAGVHAIAPLGSTGELAYLEEPEVDAVIDTTLSAVAGRVPVIVGVSDVTTAKTIRRAQYAQRAGADAVMILPVSYWKLTEREIFRHYRSISDAISIPIMAYNNPATSGVDMPPELLVRMFESIDNVAMVKESTGDLTRMQRIAELSGNRLPFYNGSNPLVLDALKAGASGWCTAAPCLRPQPCIDLYGAVRANDLDAAQRLYDDLKPLLTFIVAGGLATTVKAGLELLDFKVGDPRAPLLPLDEQGRAELRKLLAA

SEQ ID NO: 4095 - protein, 268 aa, Mycobacterium paratuberculosis
LCHMASTFTDSKSELMRRAAEQLTALQGRDAAEPPLTTRQKLALTCRALFDAGHDSGLAGQITARAEADGTYYTQRLGLGFDEITDGNLLLVDEDLNVLEGDGMANPANRFHSWIYRARPDVQCIVHTHAFHVAALSMLEVPLVVSHMDTTPLYDDCAFLADWPGVPVGNEEGEIITAALGDKKAVLLAHHGHVIAGASIEEACSLGILIERAAKLQLAAMAAGTVKQLPEELAREAHDWTLSPQRSRANFAYYARRALARHPDALTS

SEQ ID NO: 4096 - protein, 178 aa, Mycobacterium paratuberculosis
VTALLRPVRRQRGLTLEALAAQTGLTKSYLSKIERGQSTPSIAVALKVARALDVDVGRLFSDETAREKIAVERAGGPGGRRYRVLASSMLGKTMSPFVIRPTEQLADDPHPEHAGQEFLFVHAGRVELDYGDQTFTLGPGDSAYFDASVSHKVRSVGPEPAEVVAVAHAEPGSAAFAG

SEQ ID NO: 4097 - protein, 162 aa, Mycobacterium paratuberculosis
VSAGAAAGKQRTVANESGSVFDMTNVHRTASAISAVTMAVAAVLTPAAAHADGHQVTYTVTSPNNVTANVSYVNADPPSQAAFNADPSKFSTSVQAPLSGGTPVTYTATLANPNQFASITASGMLHWPDSGNGLAQFHCEIAVDGQVVVQQDATTTVTCRPS

SEQ ID NO: 4098 - protein, 536 aa, Mycobacterium paratuberculosis
MSDEPTQPPNPAGADAPGVTRRRLLTTGAVSAALGVGIGDGATLLWSQSARKRGPWPWLQPNRNDAPPVAGLHLQFGKNAGTEVVVSWHSTDAVRNPRVVFGTPASGFGRTVAADTRTYRDAKSGIEVRVNHARLTGLTPDTDYVYAALHDGAQPQQGTVRTAPMGRKPLRFTSFGDQSTPALAKMPNGRYATDNIGSPAAADTTMAIERIGPLFNLVNGDLCYANLAQNRIRTWSDWFENNSRSARFRPWMPAAGNHENELGNGPIGYGAYQTYFALPDSGSSPQTRGLWYSFTAGSVRVISLNNDDVAFQDGGNSYVHGYSGGEQKRWLATELAAARRDPDVDWLVVCMHQTAISTADRTNGADLGIREEWLPLFDQYQVDLVVCGHEHHYERSHPLRGALGTDTRTPIPVDTRSDLIDATRGTVHLVIGGGGTSAPSNAMFFPEPRCRVLTGVGAFDPGLGRKAPIYVIEDAPWSAFRDRDNPYGFVAFDVDPGPAGGNTSISATHYALTGPLGEMSVIDRFTLTKPRGDGAR

SEQ ID NO: 4099 - protein, 342 aa, Mycobacterium paratuberculosis
MRWASQAVAVNGKPVEDGALPGLQRLGLVRSVRAPQFEGITFHEVLCKSALNKVPNASALPFRYTVNGYRGCSHACRYCFARPSHEYLELNCGNDFDTQVVVKTNVAQVLRRELRRPSWRRETVALGTNTDPYQRAEGRYALMPGIIGALAESGTPLSILTKGTLLRRDLPLIANAAAQVPVSVAVSLAVGDADLHRDVEPGTPTPQARLGLISAIRAAGLDCHVMVAPVLPYLTDSVEHLDDLLGQIAAAGAGSVTVFGLHLRGSTRGWFMEWLARSHPELVGRYRELYRRGAYLPPSYRDMLRHRAAPLIAKYRLGGDHRPFSRAVAAAPAPEPAQPTLF

SEQ ID NO: 4100 - protein, 419 aa, Mycobacterium paratuberculosis
VDDAMVEHMFEYVVASRSTPEAVALLDRAREAARAEARAAAARLVAIAELLVLRCRETGERADWAADAWEAVAAQVGAALGCSVAMGHSYLRYAMAMRERLPQVGAVFAAGGIDYRAFQTLVFRTDLITDAQVLARVDATLAVLVSRRPSLTRGGLAAAVDRVVAAVDADAVRRARDAVTGRYLDVRANESGMAWVEGNVLGPDGHALDRRLDELASGVCAGDPRSRAQRRADALGALAAGAGRLACGCGSPDCPSAAAPAPRSTVVIHVVAEQATVAGRGATPAVVAGLDGLIPAQVIAELAASARLVPVAVPEGGPEPGYTPSARLADFIRCRDLTCRAPGCDRPAVDCDVDHTIPYAQGGPTHPSNLKCLCRGHHLLKTFWGWRDRQLPDGTVIWTLPDGDTYVTTPGSALLFPTL

SEQ ID NO: 4101 - protein, 420 aa, Mycobacterium paratuberculosis
VPEFSAPKGVPDYVPPDSAQFVAVRSGLLDAARRAGYGDIELPIFEDTALFARGVGESTDVVSKEMYTFADRGDRSVTLRPEGTAGVVRAVIEHGLDRGTLPVKLCYAGPFFRYERPQAGRYRQLQQVGVEAIGVDDPALDAEVIAVADAGFRSLGLDGFRLEITSLGDDSCRPQYRELLQDFLFGLDLDEETRRRARLNPLRVLDDKRPEVRAMTADAPVLLDHLSDAAKQHFDTVLAHLDALGVPYVINPRMVRGLDYYTKTTFEFVHDGLGAQSGIGGGGRYDGLMRQLGGQDLSGIGFGLGVDRTLLALRAEGKSVGSAARCDVFGVPLSDQAKLRLAVLAAGLRAAGVRVDMAYGARGLKGAMRAADRSGARIALVLGDRDIDAGTVGVKDLQTGSQVSVELDSVVAEVLSQLGR

SEQ ID NO: 4102 - protein, 218 aa, Mycobacterium paratuberculosis
VLITGFPAGMLACNCYVLAQRPGADAVIVDPGQRAMGPLRRILDRHRLTPAAVLLTHGHIDHMWSAQKVSDTYGCPTYIHPEDRFMLKDPIYGLGPRLAQLAAGVFFREPRQVVELDRDGDKLDLGSVTVNVDHTPGHTRGSMCFRVSSDKQVVFTGDTLFERSVGRTDLFGGSGRDLLTSIVDKLLVLDDDTVVLPGHGNATTIGAERRLNPFLEGL

SEQ ID NO: 4103 - protein, 313 aa, Mycobacterium paratuberculosis
LSWPAGAARFTDHGGIAAVPTNEQRRANAKRKLERQLERRAKQARTRRILLIAAGSIVAVAVIAAVVVTVLNNRNEHKASTAAPSTSTSAPETTTPGQPSQVPPLPPFKPSADVGANCQYPPSPEPAAKQVKPPRTGKVPTDPAQVSASMVTNQGHIGLMLANNESPCTVNSFASLIGQKYFDNTKCHRLTTSPSLGVLQCGDPKGEGTGGPGYQFANEYPTDQYPPNDPKAQQPVLYPRGTLAMANAGPGTNGSQFFMVYKDSQLPPQYTVFGKIQDDGLATLDKIAKAGVAGGGEDGAPATEVTITSVLLD

SEQ ID NO: 4104 - protein, 550 aa, Mycobacterium paratuberculosis
VTLDPDSFGHYRILELLGRGGMGRVYRAYDATTDRVVALKVLPPHLAEDQDFQQRFRREARIAAGLNDPHVVPIHGYGEIDGRLYVDMRLIEGRDLAHYITENGGRLSPQRAVAVIEQVAAALDSAHRAGLIHRDVKPMNVLVTTARDFVYLIDFGLARAQADTALTQTGATMGTVAYMAPERFTGTTDHRADVYSLACVLHECLTGKRPFAGDSLEEQLNAHLNTAPPRPSATAPEVPAAFDAVIARGMAKDPERRYQSVTELAEAARAALAPGVVEKPSAPTPQPRAARRVRAAVVGASALTLAVVAAVVVAMVTHGHGPRGAAPKTPGSPAPGRPAPPLPAFVAPPDLGANCQYRAVPDPSSRPVSPPPSGRVPTTPGQIGAVIATNLGDIGISLANSESPCAVNSFISLARQRFFDNTQCARLVDSPDGGSLLCGGPDVDGSGGPGYEFADEYPANQYRPDDPALRATLLYPRGTVVMATEGPNTNGSQFALIFHDSEMDPQSTVLGTIDPAGLATLDKIARAGIAGNRPSGPPANPVTITSVRIG

SEQ ID NO: 4105 - protein, 329 aa, Mycobacterium paratuberculosis
MSHRNAPLSETGRLRLARCVVDEGWSLRRAAERFQVSVTTAERWARRYRELGEAGMADRSSRPHHSPNRTPTRTERRIIKVRVIRRWGPARIGYLLGIHPSTVHRVLTRYALAKLRWLDRSTGRIIRRMEPAGCGDLVHVDVKKLGKIPAGGGWRMLGRAIGGHNSNADKSSGVFSKHRNPIRGYHYLHTAIDGYSRLAYSEVLDDEIKETAAEFWTRANAWFAECGISVRKVLTDNGSCYRSRVFAQALGDIEHRRTRPYRPQTNGKVERFHRTLADEWAYARLYRSDTERCEEFTTWLHTYNHHRGHTALGGQPPASRVPNLSGQYS

SEQ ID NO: 4106 - protein, 788 aa, Mycobacterium paratuberculosis
VAEENSAAQALDAPAESPPNPVIETPEPPTESLKTSSSASRRVRARLARRMTAQRSTLNPVLEPLVAMHREIYPKANVQLLQRAFEVADQRHASQLRHSGDPYITHPLAVATILAELGMDTTTLVAALLHDTVEDTGYTLAQLSEEFGEEVGHLVDGVTKLDRVVLGSAAEGETIRKMITAMARDPRVLVIKVADRLHNMRTMRFLPPEKQARKARETLEVIAPLAHRLGMASVKWELEDLSFAILHPKKYDEIVRLVAGRAPSRDTYLAKVRAEIINTLNASKIKATVEGRPKHYWSIYQKMIVKGRDFDDIHDLVGIRILCDEIRDCYAAVGVVHSLWQPMAGRFKDYIAQPRYGVYQSLHTTVVGPEGKPLEVQIRTRDMHRTAEYGIAAHWRYKEAKGRNGVPHPHAAAEIDDMAWMRQLLDWQREAADPGEFLESLRYDLAVQEIFVFTPKGDVITLPTGSTPIDFAYAVHTEVGHRCIGARVNGRLVALERKLENGEVVEVFTSKAANAGPSRDWQQFVVSPRAKAKIRQWFAKERREEALEAGKDAMAREVRRGGLPLQRLVNAESMSAVARELHYADVSALYTAIGEGHVSARHVVQRLLAELGGIDQTEEDLAERSTPTTMLRRPRSSDDVGVSVPGAPGVLTKLAKCCTPVPGDQIMGFVTRGGGVSVHRTDCTNAASLQQQSERIIEVHWAPSPSSVFLVAIQVEALDRHRLLSDVTRVLADEKVNILSASVTTSGDRVAISRFTFEMGDPKHLGHLLNVVRNVEGVYDVYRVTSAA

SEQ ID NO: 4107 - protein, 180 aa, Mycobacterium paratuberculosis
MTDAGEATPVAELIASLTRQVPDFPKPGIQFKDLTPLFAEATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHSLTCQ

SEQ ID NO: 4108 - protein, 557 aa, Mycobacterium paratuberculosis
VAIRIGRRGLTGWVGIGMAVLVVAGVALAGCAGSAAAEIDYVVDGPLSSYNPNTVVGAASAGAQAFARTLVGFSYHGPDGQTVPDRDFGTVSVVGGTPLVLDYQIADNAVYSDGKPVTCDDIVLAWAAQSGRYPEFNAATQAGYLDIANVECMPGQKKARVSFVPDRGIVDYNQLFTATTLMPSHVIADQLNVDVTAALLSHNAPLVAQIARLWNTIWDLKPGLKGEEIVKRFPSSGPYKLQAVLDGGAVVLVANDRWWGPKAITKRITVWPQGPDIQDRVNNRSVDVVDVAVGSSGTLATPDNYDRSDAPSDGIEQLIFAPQGPLSAPKARRAFALCTPRDVLAKDAGTPIANSRLDPAVDDAVSADDGAAEAAPFGKADPVAAREALGGAPLAVRIGYQGPNARLAVNVGVITKACAPAGITVSGVTLDSAGPQALRDGKIDALLASTGGATGSGSSGSSAMDAYALHTGNGNNLSGYSNPQVDNAIGALAVSADPAERVRLLAETAPVLWGDLPTLPLYRQQRTLLISKKMYAVSKNPTRWGAGWNMDRWALVQ

SEQ ID NO: 4109 - protein, 435 aa, Mycobacterium paratuberculosis
MTSSKASKAAKGATEITETSSGASELTDSDAAAAGLPRHSFLSRLYTGTGAFEVVGRRRLWFGISGAIVAVAILSIALRGFTFGIDFNGGTTVSMPAAGTHGTVHTAQVQEVFRKTLGTDPESVVVVGNGAAATVQIRSETLTNDQTTKLRNALFDAFGPKGADGKPSKQAISDSQVSETWGDQITDKALIALVVFLALVGLYITVRYERYMTLAAIAAMFFDLTVTAGVYSLVGFEVTPATVIGLLTILGFSLYDTVIVFDKVEENTRDFQHTNRRTFAEQANLAINQTFMRSINTSLIGVLPVLALMVVAVWLLGVGTLKDLALVQLVGILVGTYSSIFVATPLLVTLRERTELVRTHTRRVLKRRAGGARASAESTADDAAEPPAGSGDEATEAERESRSSRPAPSKPAPGARPVRPTGARRPTGKRNVGRR

SEQ ID NO: 4110 - protein, 607 aa, Mycobacterium paratuberculosis
VASSSVPVHPARYLSVFLLLLVGVYLLVFLTGDKRAAPKLGIDLQGGTRVTLTARTPDGSAPSREALAQAQQIISARVNGLGVSGSEVVVDGDNLIITVPGNDGNEARNLGQTARLYIRPVLNSMPAQSGEPKPAPRQPAQPAPGQPAPGQPAPAPGQPAPAPGQPAPGQPVPAPAQPGAAPAQPRPYPQDPPPSPSPAPAPAPAPGPAPAPAPAPSPGEAPPGEQPAPPDPRKDLAERIAEEKKWRQSTRQGIQFLALQFQATRCDKDDILAGNDDPAQPLITCSTDHKVAYLLGPSIISGDQIKDASASQNQRGIGFVVDLQFKPAAANTWADFTAAHIGTQTAFTLDSQVVSAPMIQEAIPGGRTQISGGDPPFTAATAKQLANVLKYGSLPLSFQSSEAQTVSATLGLTSLRAGLIAGAIGLLLVLLYSLLYYRVLGLLTALSLAASGAMVFAILILLGRYINYTLDLAGIAGLIIGIGTTADSFVVFFERIKDEIREGRTFRSAVPRGWTRARKTIVSGNAVTFLAAAVLYFLAIGQVKGFAFTLGLTTILDLVVVFLVTWPLVYLASKSPTLAKPAYNGLGAVQQVARERRAAAHVSTGQG

SEQ ID NO: 4111 - protein, 108 aa, Mycobacterium paratuberculosis
MESLILFLPFLLIMGGFMYFASRRQRRAMQATIELHESLRPGDRVHTTSGLQATVVGLTDDTVDLEIAPGVVTTWMKLAIRDRIVPDDEDDLVDGDDSAGEGSVSKDS

SEQ ID NO: 4112 - protein, 449 aa, Mycobacterium paratuberculosis
VARLEQTRRLVTEIPGPASLELSKRRAAAVSHAVNVSVPVFVARAGGGIVEDVDGNRLIDLGSGIAVTTIGNSAPRVVDAVRAQVAEFTHTCFMVTPYESYVAVAEMLNRITPGAGDKRSVLFNSGAEAVENAVKVARAYTRKPAVVAFDHAYHGRTNLAMALTAKSMPYKGGFGPFAPEIYRAPLSYPYRDGLLDKELATDGEKAAARAINIIDGQIGADSLAAVIIEPIQGEGGFIVPVEGFLPTLLDWCRRNDVLFIADEVQTGFARSGAMFACEHEGPNGLEPDLICTAKAIADGLPLSAVTGRAQIMDAPHVGGLGGTFGGNPLACAAALATIETIESDGLIERARQLERLITEPLLRLQARDDRIGDVRGRGAMIAIELVKSGTAEPDKDLTQRLSVAAHAAGVIVLTCGMFGNIIRLLPPLTISDELLAEGIDILGGLLADL

SEQ ID NO: 4113 - protein, 1173 aa, Mycobacterium paratuberculosis
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 4114 - protein, 314 aa, Mycobacterium paratuberculosis
VRRCRVEGRGGGAAGGSARSGARAVPSPGGCGAAPTRVAGRRTSPVTAASPASMATGGGGFDPAAWVTSGNRRVPMSSRKYAGIQRGDVMKYAEDGHTRGLSMPRSRGAVSGLLLVILGAWGALIPFVGPHFNFAYTPDRDWAWSSARGWLEVAPGAATALGGLLLIVAGNRVAAMLGGWLAVLAGAWFVVGGQLAPLLGIGSAGDPIAATERKRALLEVTYFSGLGALIIFVGGVVLARTSARLARDVQPLASDAPAAPAVEPYRDPAYDPADVSSGALTKPRTSADPEPKRGWRKNRAGGNAAYLRWPHPQQ

SEQ ID NO: 4115 - protein, 351 aa, Mycobacterium paratuberculosis
MTAHDADWSDRDVSGALVPGEGDIDVSLRPRSLREFIGQPRVREQLQLVIEGAKNRGGTPDHILLSGPPGLGKTSLAMIIAAELGSSLRVTSGPALERAGDLAAMLSNLVEHDVLFIDEIHRIARPAEEMLYLAMEDFRVDVVVGKGPGATSIPLEVAPFTLVGATTRSGALTGPLRDRFGFTAHMDFYEPAELQQVLARSAGILGIELGAEAAEEIARRSRGTPRIANRLLRRVRDFAEVRADGVITRDVAKAALAVYDVDELGLDRLDRAVLTALTRSFGGGPVGVSTLAVAVGEEAATVEEVCEPFLVRAGMVARTPRGRVATAQAWTHLGMVPPAGAAGLGQPGLFD

SEQ ID NO: 4116 - protein, 199 aa, Mycobacterium paratuberculosis
MIASVRGEVLEVALDHAVIEAAGVGYRVNATPSTLSTLRTGTQARLITAMIVREDSMTLYGFTDAETRDLFLTLLSVSGVGPRLAMATLAVHDAGALRQALHDGDVAALTRVPGIGKRGAERMVLELRDKIGAAGAAGAPAGAARNGHAVRGPVVEALVGLGFAAKQAEEATDKVLAAEPEAGTSGALRAALSLLGKSR

SEQ ID NO: 4117 - protein, 188 aa, Mycobacterium paratuberculosis
MRVMGVDPGLTRCGLSVVESGRGRTVVALDVDVVRTPSDAPLAERLLSISDAVEHWLATHQPDVVAIERVFSQLNVTTVMGTAQAGGVVALAAAKRGIGVHFHTPSEVKAAVTGNGAANKAQVTAMVTRILALQAKPTPADAADALALAICHCWRAPMIARMARAEALAAQQRQKYKDKVDATLRAAR

SEQ ID NO: 4118 - protein, 203 aa, Mycobacterium paratuberculosis
VGSLLVMLAIVLFIASIVVLVVALRRPKQPARPAGRPDPLAADALPQFGPRQLGPGAVVSYGGTDYIVRGSVTYREGPFVWWEHLLEGGDQPLWFSVEEDDGRLQLALWVTRKDLSLRPGDNYVVDGVTFHESERGRASYTTEGTTGLPAGGEMEFVDCTNADETALLSFERWAPDMPWEVSTGRPVSPGEITVYAAPPPSSA

SEQ ID NO: 4119 - protein, 167 aa, Mycobacterium paratuberculosis
VPLHQLAVTPADVSGEKLGLALNAPVPAPLVSHRLDHPGGGALLLGVLGASHVVAVEHAFSEEISCTARSFGADLPERAEAPGYRLRSRSDARDEASFRRLADDLRDRCARRPGWLGGSFPGDGAALTVLAARPDGAGWRWRTWHLYPDLPAGRGGTVVRTASRWHP

SEQ ID NO: 4120 - protein, 480 aa, Mycobacterium paratuberculosis; identical to SEQ ID NO: 2670

SEQ ID NO: 4121 - protein, 480 aa, Mycobacterium paratuberculosis; identical to SEQ ID NO: 2670

SEQ ID NO: 4122 - protein, 339 aa, Mycobacterium paratuberculosis
DLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFPALERAFDYNKSRAALILLTGYQTPDALRSAGGARVAAFLRKRKARNADTVAATALQAANAQHSIVPGQQLAATVVARLAKEVMALDTEIGDTDAMIEERFRRHRHAEIILSMPGFGVILGAEFLAATGGDMAAFASADRLAGVAGLAPVPRDSGRISGNLKRPRRYDRRLLRACYLSALVSIRTDPSSRTYYDRKRTEGKRHTQAVLALARRRLNVLWAMLRDHAVYHPATTTAAA

SEQ ID NO: 4123 - protein, 399 aa, Mycobacterium paratuberculosis
VAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFPALERAFDYNKSRAALILLTGYQTPDALRSAGGARVAAFLRKRKARNADTVAATALQAANAQHSIVPGQQLAATVVARLAKEVMALDTEIGDTDAMIEERFRRHRHAEIILSMPGFGVILGAEFLAATGGDMAAFASADRLAGVAGLAPVPRDSGRISGNLKRPRRYDRRLLRACYLSALVSIRTDPSSRTYYDRKRTEGKRHTQAVLALARRRLNVLWAMLRDHAVYHPATTTAAA

SEQ ID NO: 4124 - protein, 151 aa, Mycobacterium paratuberculosis
MYLAVEIGTVDLNPVLKGAVATILYFAVGMAVLLVGFYAVDLLTPGKLRQLVFIDRRPNAVVVAGAMYIALTVVIITAIANSYSQLGQGLVGVAVYGLMGVILLGVALLAMHLLIPGSFHEHVEEPQLHPGSFAVALILLAVGGVTAAAVS

SEQ ID NO: 4125 - protein, 523 aa, Mycobacterium paratuberculosis
MSTVEVSAPEAAPPSPGRWRALLLAAVAACAACGIIYELALLTLSASLDGGGIVATSLIVAGYIAALGVGALLAKPLLARAALGFITVEALLGVVGGLSAAALYVVFAFLDGSVGSTWVLAVSTALIGGLVGAEVPLLMTLLQRGRTAGPADAGRTLANLDAADYLGALLGGLVWPFLLLPHLGMIRGAAATGMINLAAAAVVAIFLLRQVVSARQLALALCALAAALALLAGLLLRSADVETTSRQRLYADPIIAYRHTPYQEIVVTRRGDDTRLYLDGGLQFSTRDEYRYTESLVYPALGNGARSVLVLGGGDGLAARELLRQPGISRIVQVELDPAVIEIARSTLRAANGGSLDNPRVRVLTGDAMAWLRGPNPDRFDAVIVDLPDPDTPVLGRLYSTEFYALAAHALAPGGLLVVQAGSPFSTPTAYWRTVSTIRAAGYAVTPYHVHVPTFGDWGFVLAQRGDTPPAPKVPPDAPPLRFLDQRVLQAAVVFSGDVGPRPLEPSTLDNPRIVGDMRHGYD

SEQ ID NO: 4126 - protein, 250 aa, Mycobacterium paratuberculosis
MSGHSKWATTKHKKAVIDARRGKMFARLIKNIEVAARVGGGDPAGNPTLYDAIQKAKKSSVPNENIERARKRGAGEEAGGADWQTITYEGYAPNGVAVLIECLTDNRNRAASEVRVAMTRNGGTMADPGSVSYLFSRKSVVTCEKNGLTEDDILAAVLDAGAEEVEDLGDSFEIICEPTDLVAVRTALQDAGIDYDSAEAGFQPSVTVPLNADGAQKVMRLVDALEDSDDVQDVWTNADIPDEILAQIEE

SEQ ID NO: 4127 - protein, 165 aa, Mycobacterium paratuberculosis
VSAPRIGVLALQGDTREHLAALREAGAESMPVRRRGELEAVDGLVIPGGESTTMSHLLKDLDLLEPLRGLLADGLPAYGACAGMILLASEILDAGAGGREALPLRAIDMTVRRNAFGRQVDSFEGDIAFAGLDGPVRAVFIRAPWVERAGDGVEVLARAAGHVVA

SEQ ID NO: 4128 - protein, 278 aa, Mycobacterium paratuberculosis
VSIEQILDLEQLEVNIYRGGVFSPDSGYFQRTFGGHVAGQSLVSAVRTVDPRYQVHSLHGYFLRPGDAKERTVFIVERTRDGGSFATRRVNAIQHGEIIFSMGASFQTDQEGIHHQDAMPAAPPPDGLPGLDSIKVFDDAGFKQFEEWDVCIVPREKLQLTPGKASQQQVWFRHRDPLPDDPVLHICALAYMSDLTLLGSAQVTHLDVREHLQVASLDHAMWFMRAFRADEWLLYDQSSPSANGGRSLCQGKIFTQSGEMVAAVMQEGLTRFQRGYRQ

SEQ ID NO: 4129 - protein, 303 aa, Mycobacterium paratuberculosis
VNTAHSPDGSGRTGTARVKRGMAEMLKGGVIMDVVTPEQAKIAEGAGAVAVMALERVPADIRAQGGVSRMSDPDMIEGIISAVTIPVMAKARIGHFVEAQILQSLGVDYIDESEVLTPADYTHHIDKWKFTVPFVCGATNLGEALRRINEGAAMIRSKGEAGTGDVSNATTHMRAIGGEIRRLMSLSEDELYVAAKELQAPYELVVEVARAGKLPVTLFTAGGIATPADAAMMMQLGAEGVFVGSGIFKSGDPAQRAAAIVKATTFYDDPDVLAKVSRGLGEAMVGINVEQIAQPERLAERGW

SEQ ID NO: 4130 - protein, 341 aa, Mycobacterium paratuberculosis
MTWLMVGIAILVAVLAVVGVWAYRTANRLDRLHVRYDLSWQALDGALARRAVVARAVAIDAYGGASEGRRLAALADAAEAAPRAAREARENELSAALAAVDPASLPAGLIAELADAEARVLLARRFHNDAVRDTLALAERRLVRLLHLGGTAALPSYFEIVERPHALAHGDHGVLNHRTSARVVLLDDRGAVLLLRGSDPALAGQQAPKWWFTVGGEVQPGERLAEAAARELAEETGLRVAPSELVGPVWRRDEVFEFNGSLIDSEEFYFVYRTQRFEPSRTGRTELEHSYIHGHRWCDAADIAQLVAAGETVYPLQLSGLLTDAAALASGRTPGPLLSIR

SEQ ID NO: 4131 - protein, 374 aa, Mycobacterium paratuberculosis
MRIGMVCPYSFDVPGGVQSHVLQLAEVMRCRGHDVSVLAPASPHAVLPGYVVSAGKAVPIPYNGSVARLRFGPATHRKVKKWLVDGDFDVLHLHEPNAPSLSMLALNIAEGPIVATFHTSTTKSLTLTVFQGILRPMHEKIVGRIAVSDLARRWQMEALGTDAVEIPNGVDVASFASAPRLDGYPRAGKTVLFLGRYDEPRKGMAVLLDALPRLVERFADVQLLVVGRGDEDQLRTQAGELVKHIRFLGQVDDAGKASAMRSADVYCAPNLGGESFGIVLVEAMAAGTPVVASDLDAFRRVLRDGEVGALVPVGDGDALADALIAVLEDDGLRDGYVAAGQAAVQRYDWSVVASQIMRVYETVAATGAKVEVAS

SEQ ID NO: 4132 - protein, 320 aa, Mycobacterium paratuberculosis
VMPTPPGMRAITAPGRLAGRLVGGVGADWAYATGWMAVRAMPEFAARNAFDAAARYAARGGGPDQLRKNLARVLRVPPADVPDALMRASLASYARYWREAFRLPSMDLTELGRRLQDSVRGEDNLDAALRAGRGAVIALPHSGNWDMAGVWLAQSHGTFTTVAERLKPESLYRRFIAYRERLGFEVLPLSGGERSPFEVLCDRLRANRVVCLMADRDLTRTGVQVDFFGEATRMPAGPAKLAIATGAALLPVHVHFEGEGWRFLIYPALDCSSGDVGAITQVLADHFEKNIAAHLEDWHMMQPQWLADLPDSTRARLRDS

SEQ ID NO: 4133 - protein, 213 aa, Mycobacterium paratuberculosis
MSKVPFLSRAAFARLTTPTARACLRLGLTPDVVTVAGTIVAVAGALILFPIGELFVGTLVVWFFVLFDMLDGAMARERGGGTRFGAVLDATCDRVSDGAVFGGLLWWVAFGLHDEPLAAATLICLVTSQVISYIKARAEASGLRGDGGIIERPERLIIVLVGAGLSDLPGYPLPWALPVAMWALAAASLVTCAQRLHTVRTSPGATDRGSDAP

SEQ ID NO: 4134 - protein, 194 aa, Mycobacterium paratuberculosis
VSDPEQAEQDAERTILDRGVGEQDHLQRLWTPYRMTYLAEAPMKRGPNSSGKSEQPFTDIPQLTDEDGLVVARGELVYAVLNLYPYNPGHLMVVPYRRVSELEDLTDAESAELMSFIQKAIRVIKNVSRPHGFNVGLNLGTSAGGSLAEHLHVHVVPRWGGDANFITIIGGSKVIPQLLRETRQLLATEWAKQS

SEQ ID NO: 4135 - protein, 684 aa, Mycobacterium paratuberculosis
MTVPATDSCPAPIRVPAGTTAAAAVRDAGLPGRGAPDAVVVVRDASGTLRDLSWVPDTDAEVVPVAANTDEGRSVIRHSAAHVLAQAVQELFPQAKLGIGPPITDGFYYDFDVPEPFTPEDLDKLEKRMRQIVKEGQLFSRRVYESKEQARAELAGEPYKLELVDDKSGDPDIMEVGGDELTAYDNLNPRTRERVWGDLCRGPHIPTTRHIPAFKLTRSSAAYWRGDQNNASLQRIYGTAWESQEALDDHLRLIEEAQRRDHRKLGSELDLFSFPDEIGSGLAVFHPRGGVVRRELEEYSRRKHIEAGYEFVNTPHITKAQLFHTSGHLDWYADGMFPPMHLDAEYDDDGTVRKPGQDYYLKPMNCPMHTLIYRSRGRSYRELPLRLFEFGTVYRYEKSGVVHGLTRARGFTMDDSHIFCTREQLHGELASLLRFVLELLGDYGLTDFYLELSTKDPDKFVGSDEVWEQATTSLADVAAESGLELVPDPGGAAFYGPKISVQARDALGRSWQMSTIQVDFNFPERFELEYTASDGTRQRPVMIHRALFGSIERFFGILTEHYAGAFPAWLAPVQAVGIPVADEHVPYLESVAAQLKSYGVRVEVDASDDRMAKKIVHHTAQKVPFMLLAGDRDVAAGAVSFRFGDRTQINGVPRDSAVDAIVKWIADRENSVPSAELVKVSSGE

SEQ ID NO: 4136 - protein, 585 aa, Mycobacterium paratuberculosis
MLSGRPNGEQGRRVATVRSGTMRSMGAQTALTLLLAAIAVIVLVDWISERTRLPSATLLVLVGIGQALLPGPTIGLEPDVVMTCILPPLLYHAALESSLVGIRRNLRTVVSLSVVLVLLTAASVGVAFSLLVGGATLAVGMVLGAAVAPTDPVAALAVARKEGLPLNIVTLIEGEGLLNDATALTTLAVAVTVARGAAFSAPSAIREFVLAAVGGLVVGQVFAYARRLLRRWRHDVLTANAISLATPFLTYLVAEKLSASGVLAVVVCGLIVGHDSPRVESGASRLQTRAVWRLVNFLLEGVVFLLIGHQVPVILDELGGYALSTILVAVGVTVAVVLLVRPLWLLLTQALPRSLHTRLGNVDDSATDSAEPRPERTRERLSGREIVVLSWAGTRGVVSLAAIFAVPVLTEGNAPFPDRDLLLFCTLVVVLVTLIGQGVTFGPLVRALGLRAKTTDELRLRNRARAAALRAALDRLDSLDPEDGADVDPRVIDGVRQQLSAQLERYEHRLTLLSDVDELPAAPAYEAAVGLRRVAIDAQRDELVRWRDAGMLPDQSLRAIERELDHEESMLPMGLPRSPRRSQKR

SEQ ID NO: 4137 - protein, 424 aa, Mycobacterium paratuberculosis
MTGSASPCGPVLAGLPGIRGWQEDLYRDLHRHPELSHQEHRTAAAVAERLRGFGYDVHEGVGGTGVVGVLRNGTGPAVLLRADMDALPVREDTRLPYASAVTATDPHGDERPVMHACGHDVHVTCLLGAASLLAGAREHWRGSLVAVFQPAEELGDGARRMDDDGLARLVGHVDVALAQHVLPFPAGQIVTRSGPFMATADSMRVTVYGRGGHGSMPQTTVDPVVLAAMIVIRLQTVVSREVAPTETAVLTIGRIESGAKSNVIGDHAVLELNLRTFSGQTRDRMLDAVRRIVTAECQASGSPRDPEFELMNHFPATDNDPAVTARVRAVFAEHFGDRATEIPAQTGSEDFSDIANGLDALYSYWGFGGADPGAYRRAEAAGRLAEDVPVNHSGRFAPVIQPTLDTGTEALTVAALAWLAPSGS

SEQ ID NO: 4138 - protein, 208 aa, Mycobacterium paratuberculosis
VVVAEHQRHPGGGFNPPEPTTKGGPDYGRFIDAVRALQDHARAVDAPDEVITQAADQLEKVSALLAPFDADEWASPSGRRMDLPMRGNILTIPMSAQKGADGRMHGQARFARFHLGRNGAVHGGSLGMLFDTVLGLTASVLTGSRRQRTAYLKIDYRSIVPIETELQFDAGVDRVDGRKIFVSGRLTHGERLLTEADALFVRLKPGQP

SEQ ID NO: 4139 - protein, 308 aa, Mycobacterium paratuberculosis
LPRRGARRGSAGTVGGVSAPQTIAQASGTLTLGGDLTVNRLGFGAMRLTGAGVWGPPADRDECVRVLRRAVELGVNFIDTADSYGPYVSEEIIREALHPYDGLVIATKAGLLRTGPDIWIPLGNPSYLRQECEMSLRRLGTDTIDLFQLHRIDPNFPLQDQVGELLTLKNEGKIRHIGLSEITPDQLAAAQQITEIVSVQNMYNVTARRAEPLLDAATRQGIAFIPWFPLAAGPLAAPDGPLQRIAAEHDATPSQLALAWLLKRSPVMLPIPGTSKVAHLEENVAAARITLSDEEFEALSTAGTQQTV

SEQ ID NO: 4140 - protein, 166 aa, Mycobacterium paratuberculosis
VDLRALEELPLTYSEVGATASGDLPAGYHHQHVERQIGTGAERFEQAAGAVLRWGMQRGSGLRVQASSEVAVVDAVVVVRLGFVPAPCRVVYVVDEPDIRGFGYGTLPGHPESGEERFVVRHDPATSAVYAEVTAFSRPATWWARAGGPVLRVGQRVIARRYLRAV

SEQ ID NO: 4141 - protein, 313 aa, Mycobacterium paratuberculosis
MLSTPWSAGFGLRVPIVNAPMGGVAGGRLAAAVTAAGGLGMVGMGSVATRRLLAEQLQYVDGRFGIGLVDWVMRNEAGLLEDALAARPALLSVSFGTDWSWVAKAHDAGIPTVTQVYDSLGARQAVDAGVDILVARGSEGGGDGEVKLGLLPLLDAALDAVSVPVLAGGGVASARSLAAVLAAGASGAWVGTRLSACPEALTADGNRRALVEAAETDTAVTRAFDVAKGLPWPARFPSRVLANDFVERWTGREETLDAGACEELAAAIAAGDCRVAPVDAGQGVGMIRNDATVAEVIDEMCSGAEQLLSRWGS

SEQ ID NO: 4142 - protein, 114 aa, Mycobacterium paratuberculosis
MDSVSLTDLAAEKLAEAKQSHSGRAAHTIHGGHTHELRQTVLALLADHDLSEHDSPGEATLQVLQGHVRLTTGGDAWEGRAGEYVAIPAERHALHAVEDSVVLLTVLKTIPSAH

SEQ ID NO: 4143 - protein, 141 aa, Mycobacterium paratuberculosis
MSTGTAIAVALTFVWLGMVLAISFLEAPLKFRAPNVTLQIGLGIGRLVFRALNTVEVVFALVIGAIVVAGPTRAGVAVAIGVAVAALAVQLVAVRPALTRRSDRVLAGDDGPRSRAHYGYVALEAVKVVALIAAGILLLSG

SEQ ID NO: 4144 - protein, 234 aa, Mycobacterium paratuberculosis
VGDPLTKSRKLLAPSAGESAGRRRAVLRLLRASPEPMSIAGIADVLGVHPNTVRFHLDSLVADGQVEHVELDRKGPGRPPLMFRAVRQMDRGGTRHYRLLAEILAKAFAAETDPAPKALAAGRAWGQQLDAERRRLPRDAAGAEQAIAQLVDVLDELGFAPERRVIDGEQQVGLRHCPFLELAENSSNVVCPVHLGLMQGAMETWGAPVSVDRLDPFVEPDLCLAHLTLQGAGR

SEQ ID NO: 4145 - protein, 118 aa, Mycobacterium paratuberculosis
MTYVIGKPCIDVMDRACVDECPVDCIYEGGRALYIHPDECVDCGACEPVCPVEAIYYEDDLPEDLKPHLADNEAFFAEPLPGRDAPLGSPGGAAKLGPLGVDTPLVASQPSAAHSDGS

SEQ ID NO: 4146 - protein, 281 aa, Mycobacterium paratuberculosis
MAANELRTGSEPPLPGSHRADEAVAGHWLLARLGKRVLRPGGVELTRTLLSHAQLTGADVVELAPGLGRTATEIVARAPRSYVGAEADPDAANVVRGVLGDLGAHNAAVRVADAADTGLPDASGDVVIGEAMLTMQGDAAKRAIVAEAARVLRPGGRYAIHELALTPDTVSEEVSTDIRRALARAIKVNARPLTVAEWSALLAEQGLVVDHVATAPMALLQPRRLVSDEGLFGALRFARNVLVHRDARKRVLTMRRTFRKHRRQLAAVAIVAHKPTASQTG

SEQ ID NO: 4147 - protein, 78 aa, Mycobacterium paratuberculosis
MPVMGASPMTESDLDALASDFLQSHYLGSTYADWSPDRRLDMFLRRRGLARVANDGDLSHNVLQRIMARAGRASLARH

SEQ ID NO: 4148 - protein, 87 aa, Mycobacterium paratuberculosis
MNSPKWMVHWPQRRPTATIYQLTDRLHRGHVARVPAHQITATVSAWLADLGADSPLVDELERAVRGGDWAAAHALGECLSIEIAVAD

SEQ ID NO: 4149 - protein, 408 aa, Mycobacterium paratuberculosis
MTNLLWPGEHRAGEHMTDAALLDAMVAVESAWLAALTGAGLAPADCAAADLRNLVADNDFETLAVGAEDGGNPVIGLVRLLRERADPAVAPWIHRGLTSQDVLDTTLMLGVRALADDLIAELREQIRVLSALTDRHRATPMVARTLTQHAAPTTFGGKAAGWLNGVIDAFDNVIALVTPVQIGGAAGTLAASTELAALRTGTADPAAVSVELARCTAAALGLAPRPPWHTARAPITAAADALVGCTDSWGRIAADVVTLARPEIGELGEPATATRGGSSSMPHKRNPVLSILIRRAAIAGPPLAATLHTAAALAGDERPDGAWHAEWDTLRILGRRTAVAASQCTELLAGLSVHTARMAENLAAADVLGEQRAIAELAGGAPSPTYFGAVDRVIDETLRRAARVRPER

SEQ ID NO: 4150 - protein, 187 aa, Mycobacterium paratuberculosis
MTETACTPGQTVGPFLDLGLPYPGDARLVDDGDPRAVRLHGTVYDGVGAAVPDALVELWQPDGAGRIVRQAGSLRRDPAVFTGWGRCATGEDGGYGFTTLAPGSVIDGRTPFFALTVFARGLLNRLFTRAYLPGAGPDTDPLLARVAPERRTTLLCVAENGGRAYRFDIRLQGPGETVFLAYRTDER

SEQ ID NO: 4151 - protein, 254 aa, Mycobacterium paratuberculosis
MDPECVASQGDITAEIARIAAQYRADDGGAGQPLLDYPPYRATILRHPKQPLVAVDPEAAELWAPCFGRDDVDPLDADLTAGHRGEPIGERVVVAGRVVDEAGRPVAGQLVEIWQANAAGRYRHQRDRHSAPLDPNFTGAGRCLTGPDGWYRFLTIKPGPYPWRNHHNAWRPAHIHFSVFGTAFTQRLITQMYFPGDPMFELDPIFQSILDPAARRRLIAHYDHDLTQPEYATGYRWDIVLAGGGRTPTGAGND

SEQ ID NO: 4152 - protein, 161 aa, Mycobacterium paratuberculosis
LNAYDVLKEHHIVIKGLGRKISEAPVNSEERHALFDDLLIELDIHFRIEDDLYYPALKEASKLIAVAHAEHRQVVDQLSVLLRTPQSAPNYEDEWNSFKTVLEAHADEEERDMIPAPPQVHITDAELEELGNKMAAKMEQYRGSALYKMRTKGRAALVRSL

SEQ ID NO: 4153 - protein, 323 aa, Mycobacterium paratuberculosis
MVGRPRAGRLQKVGSKVVAAIGRQEWMDRPSYRFEHLLSFAYNGLGSARNTVTNALNGVWLGHPVHPPLASLTSGALGTTVALDALSVLPGQPASEVVGASRFATRALGVGILASLGSAVTGVTDWQHTHEEDRRVGAVHGLLNVAATALYVQSWFDRRRGRHGRGILLTALGYGITVAGSYLGGALVFESGIGIDQSGPRLRTSAWTPVLPASSLNGKPVRVEVDGVGLVVCQTKPGEVAAYGEFCPHLAAPMADGWLDRGRLVCPWHGSWFAAESGEVVRGPAAAPLPCYQARVVDGVVEVRGEQQPAPGGAVGIAKGGAS

SEQ ID NO: 4154 - protein, 446 aa, Mycobacterium paratuberculosis
LPGVLENVRRGMIPAHIYNDPELFALEKRRLFARAWTFVGHESEIPHDGDYMVRRVLDDSFIITRGSDGRVRAVFNMCLHRGMQVCRAELGNASNFRCPYHGWTYRNDGRLTGLPFHREAYGGDDGFVKDQTLLPAPNFAGYDGLLFISLDPAAPPLQDFLGDFRFYLDYYTRQSAGGVELRGPQRWRIRANWKIGAENFAGDMYHTPHTHASIVDIGLFREPKAQKRKDGATYWAHRGGGTTYKLPPGGFEERMRYVGYPDEMIGRIKQVWTPRQQRVVGEDGFMVSAATCFPNLSFVHNWPKVRDGRDDETLPFISIRLWQPISENETEVCSWFAVDSAAPAQYKQDSYKAYLMCFGSTGMFEQDDVENWVSLTTTAGGSMARRLLLNSRMGLYDDGRPVVEALAPSAFHGPGRAQVGYNEHNQRALLAMWADYLQEGDACENR

SEQ ID NO: 4155 - protein, 184 aa, Mycobacterium paratuberculosis
VGRLSAGRRRMRKPLTCLPFDDARHLQAHQFLVDEAYLLDAQHYQAWLDTLTDDVRYVMPVRVTTARGAGFDTSPGMAHFDEDKYSLSQRVARFATEHAWTEDPPSRLRHFVTNVRTFVEDDRHLLVESAELLFRSRGDVNESALVSCGREDVLRWSEDRWKLARRSIFVDESVLRMQNLAVFL

SEQ ID NO: 4156 - protein, 83 aa, Mycobacterium paratuberculosis
VNPAGEPIILGNEFTEVRVQRVETRNGSRLLISAPKTGRSITLDPLEVEALTWQNPRTLAAMVGNGQAPLLPDEPEDGDDRLA

SEQ ID NO: 4157 - protein, 264 aa, Mycobacterium paratuberculosis
MTGWLDGKRALVVGAGSGIGRAVVDAFAAEGAKVAALERDSDKCDRLRRQLPEVAVAEGDATTRQANERAVALAVDTFGGLDTLVNCVGVFDFYRGVADIDAGALADAFDEMFRTNVLSHLQSVKAALPALRAAGASSIVLTESASSFYPGRGGVLYVSSKFAVRGLVSALAHELAPGIRVNGVAPGGTLGTDLRGLASLGLQGTRLDDAPDRAAEVAARTPLRVALSGADHAWSFVFLASDRSRGITGETVRPDGGFGLGTPR

SEQ ID NO: 4158 - protein, 240 aa, Mycobacterium paratuberculosis
VSGRLDEQRALVAQGCRMAAARGLVDGILGHVSLRIDDERLLVRCRSDTDDGVAFTRPGDIRLVRFDGTAGAPGELDGYRVPNELPIHVETMLADPRHTAVAHLHPPAVVAADLAGITLRPIYGAHDIPGARLARGGVPVYERAVLIRDSRLAGDMVAAMRGRPVVVCRGHGITSAAATVPQAVLQAISVDALARMSLRVRAAGGTLRDIADVDWDDLPDLGPAFTAEAAWRHEVARIEG

SEQ ID NO: 4159 - protein, 271 aa, Mycobacterium paratuberculosis
MPAKRARVAGPAAAAPAADALAPQYPIESVDNALKLLLLLGEQPEIRLSEATRYLGVASSTAHRLLAMLAYRGFVRQDPVSKAYLPGPSLTGVAFAIFGRLDIARSAAPLMRALSEQLRETVHVGMLDGASVRFVAAVEGPAAVRVASRLGRALPAHCTSTGKVMLAQLSAAELRALLPRERLKRITAHSIGSRAALEAELAAIRERGYATNREESEEGVASVAVPIPTRAPGLRLALNAAAPQNRLDAARYPAVAAALVAAAKEIGDQLG

SEQ ID NO: 4160 - protein, 296 aa, Mycobacterium paratuberculosis
LARRLAHAWLAWLHGNQSPARLRVILGFVSGAIHPGYRRYVAIGDSQTEGLWDGDDGTGLLGFADRLAAMLDSAYPGLQYANLAIRGKRIGHVLAEQVPAALAMRPDLITVCAGMNDVIQPGRSFGPALTDLDHIYAALAGSGATVVTTTFPNVAQFLPLGRLVAGRLTRINAVIRAAANRHGFRLVDLYSAPSMRELNTWAVDRVHASTKGHILFAAAAAEALNLPESSHDWALGGQQRARRSVAAGAYEQWRWTQDSFVPWVWRRLRGLSSYDGREPKRPRLQGVGSASGILDA

SEQ ID NO: 4161 - protein, 221 aa, Mycobacterium paratuberculosis
MNVEPLLHSIPPLAVYLVVGGVVGIESLGIPLPGEIVLVTAALMSSHHDLAVNPLGVGVAAVIGAVIGDSIGYAVGRRFGMPLFERLGRRFPKHFGPGHVALAEKLFNRWGARAVFLGRFIALLRILAGPLAGALKMHYPRFLTANVSGAICWAGGTTALVYFAGVAAERWLERFSWIGLVVAVVAGLTAAILLRERTSRAIAELEAEHYRKTGNTATDPV

SEQ ID NO: 4162 - protein, 205 aa, Mycobacterium paratuberculosis
MTTPDAGSSGASARERVLTAAYELFSRRGIRAVGTDEVIARAGVARATLYRHFATKNDLVLAVLQRREELWTYGLIEEQSRLRGATPEEQLLAIFDVMDEWFRQGDRYEGCSFINVLLELGPEHPAGKACIAHIDRVRDIVRRRAVAAGLTDVEDFASSWHILMKGAIVLAAVGDLDAARRARRMARTLIEEHRPPLVSDTGEAV

SEQ ID NO: 4163 - protein, 145 aa, Mycobacterium paratuberculosis
MNSVIVEPMSATHLTLSTKLVYELGDPNSTLRATTARSGSAVLIYAGGEIDACNEDTWRHLVSEAAGVVTTPGPFVVDVTGLEFMGCCAFAVLTDEAKRCRQRGIDLRLVSCEPIVGRIIDACGLSDILPIYPTVDSALSGADRW

SEQ ID NO: 4164 - protein, 261 aa, Mycobacterium paratuberculosis
VSPFQMFVICLAGLAAGAINALVGSGTLITFPTLVALGYPPVTATMSNATGLVAGSVSGTWGYRAELRGQWDRLRWQLPASLAGAGLGAYLLLHLPEKVFAEIVPVLLVAALVLVVTGPRIQAWTARRAEQAGRSPEHVPPGRMATLVFGTFAVGVYGGYFTAAQGILLVGLMGALLPESVQRMNAAKNLLALVVNVVAAVAYTSVAFGRISWAAAGLIAAGSLVGGLLGARYGRRLSGGALRAIIVVVGLIGLYRLLAVA

SEQ ID NO: 4165 - protein, 313 aa, Mycobacterium paratuberculosis
MSGGLTPDQAIDAIRGTGGAQPGCRALHAKGTLYRGTFTATRDAVMLSAAPHLDGSTVPALIRFSNGSGNPKQRDGAPGVRGMAVKFTLPDGSTTDVSAQTARLLVSSTPEGFIDLLKAMRPGLTTPLRLATHLLTHPRLLGALPLLREANRIPASYATTEYHGLHAFRWIAADGSARFVRYHLVPTAAEEYLSASDARGKDPDFLTDELAARLQDGPVRFDFRVQIAGPTDSTVDPSSAWQSTQIVTVGTVTITGPDTEREHGGDIVVFDPMRVTDGIEPSDDPVLRFRTLVYSASVKLRTGVDRGAQAPPV

SEQ ID NO: 4166 - protein, 266 aa, Mycobacterium paratuberculosis
MTGMVNPDRARSRTFVVTGAASGIGLATARRLLAEGGTVVGADLADPPGGLGPRFTFVPADVTDESAVAAVLAAVPGRLDGVFHAAGVAGGGPVHLLDRAEWDRVIGVNLTGTFLVAKAALARMIDQSRVDGERGSLVTVASVEGLEGTAGGSSYNAAKGGVVLLTKNIALDYGPSGIRANVICPGFIETPMAHNVFSIPGMEAPLASITREHALQRLGRPEEIAAMAAFLLSTDASFVSGQAIAVDGGYTAGRDHGVVELFGFPS

SEQ ID NO: 4167 - protein, 70 aa, Mycobacterium paratuberculosis
PRPVAPRRTAARYRRPRRTGRGRRLGRRRASRRAQGGAGFRRGDRHRPGRLGHPRARLDAGQPRPELGGA

SEQ ID NO: 4168 - protein, 172 aa, Mycobacterium paratuberculosis
VAVVWAGAAPPGAPRVALVSGEAIAIAQGVSVTPAPGWTLGNRGPNWVALNNSDTTAQLRITVKPGAGTDAAALLQADVDQYTGGASAILTDVNRLGPPETTPLQGPNFQQQASLNYTATVVHPQGSIPVIGTFTELLNTSTGRSAFVDFRQDSSATTQAAGEGAAMIASLQ

SEQ ID NO: 4169 - protein, 515 aa, Mycobacterium paratuberculosis
MPAAETRETLAGIVERHAQRRPDAIAIRYGERQWSWAEWSSRIRRAAGALRGAGIQRGQCVAFLDKNHPACLEVLIGGASVGAVTTVVNWRVIGDELVHVLADSGARVLVVGAELRPAAEAAARRVPSLERIIEVGDEYESLLAAAEPAPSDAGVDTDETALVIYSSGTTGRPKGVLLSQRALVNHAANLAPAFPFGDGDANLVAMPLFHVGGIGYALFGIRAGAPTIMTREPDAAALIGAVRAGATHAFFVPPVIARFLDAGEAARASIAGLRYIVYGAAPMPLPLLHRALSTWPGTKFVQVYGQTELCGAVTALSDDDHRDAARPQLQLSAGKAVQGCEIRIVDPNSCAELPAGRSGEVWVRSNQNMSGYLNRAEATAETITADGWVRTGDVGRLDADGYVYIEDRLKDMIITGGENVYGPEVESVLIEHPAVVDAAVIGVPDDFWGESVKAIVVADGDVDAADVIEFCRRHLAGFKCPRTVDFVAELPRNASGKILKTQLREPFWRDRDRRV

SEQ ID NO: 4170 - protein, 293 aa, Mycobacterium paratuberculosis
LRRDASAAAPTRKEPRGAEPHTARPPRPPEGDWLGTPYLRFERYGPIALCTIDRPQARNALSPAMYFGIRYAVGRLNEDPDLAGLVLTGTGDVFAPGGDMGGGGGADNWITFGSALGMDVTPFDAVRTSAKPIVSAVNGLCQGGGFQIALCSDLSVVSDRATFRVPELFRGYADTYYSQMLARVIGPVRTRDLMFTGRVLTAVEALDWGLVTRVVPHENLLDAAKDLLAQCCRTAPRARGVIKSSLDNYLGLYDRIGMTASLSDDEAIEGFRAFKQRRSPDWVHPDLRVDGRL

SEQ ID NO: 4171 - protein, 97 aa, Mycobacterium paratuberculosis
MAGNQEGIGMLKLECPQHHPVGRILKDAPHQAVQFDPGAQVGPRRFWPDEDEQPNFTTRCRFCDQPVGEATATLQAKLAEVVADAAATAATAALPYV

SEQ ID NO: 4172 - protein, 145 aa, Mycobacterium paratuberculosis
VSKVTLTTELPIPVETASALARKPEMMRHVLSPVLRIYRLDVPKRIEVGTQGSARFWLFGVIPAWTHHLTIKRLDPTEIYTNEHGGPVRTWNHRLTFEPIDEGSCRYTDEIETDDGLRGLPTRAFARVMFRHRHRRWRRLARILH

SEQ ID NO: 4173 - protein, 193 aa, Mycobacterium paratuberculosis; identical to SEQ ID NO: 27

SEQ ID NO: 4174 - protein, 381 aa, Mycobacterium paratuberculosis
MSAALRLVTDTGTGTSDGELPPLQRYEIWMKGRGLSARTITDSMLTLRRLERVTRRPAHAVAALAISRFLADEALGPRSRYTYHVQLAGFFRWLANEDGAPNIMAQIPRPRLPRSVPRPITTGQLQALLAVRMHKRTRVMILLAAFAGLRAHEIAKVRGQDVDPDARTLHVVGKGGHAATIPLHPVLVEAAETMPRHGWWFPANSRRPGQHVLSRGVVDAIGDAMRRAGIPGGTAHRLRHWYGTTLVASGTDLRTAQTLLRHSNLASTAIYTEVYDDRRIEAIDRLTIPLPGEAERAQDDRLRRQVDRCKQSIIRLLGGLEPGEHMSRTKLSQALRSDVRPHINEAIDELTAGGMLVTVIAGHGRHYRLDSGWTDRPEFHG

SEQ ID NO: 4175 - protein, 252 aa, Mycobacterium paratuberculosis
MATNDDQDDGKPPITAAAGGDETAIGAAADETELVAPLTVPASELAWSHEDSDAGDYSWGRAAERASIIVLACAAVAVVIGLLTWLALHLHDQAKPTAGPTAARPVTIEPAAALPTVTAVQAPAAAPPATVTVTPPPAPPATVTVQAAPAPAPTVVKPAPALPPPGGTTVFSICPDGHEGVVGGHTSCAFAENVRRTFYASGMADTFTAFSPVTGDAYEMTCAGRYPAYFEDGSTKVSTRCYGGNNAEVVIW

SEQ ID NO: 4176 - protein, 100 aa, Mycobacterium paratuberculosis
VTTDHPDQPRRELPNTLAGHNLVFIYDDDDDDWDDEDFDADHGDCAFCLGREAAHRGESEDQNPYSKTGARPGSTEWYETDYGLWLLGHDVGTKIDPEMS

SEQ ID NO: 4177 - protein, 1636 aa, Mycobacterium paratuberculosis
VVGIPVYLDVESRIDQRALMATSRALVDHFARVGNDISHGLGGSLSKAFAAVDGTAARRDLLALQQEWRRAADVEADAAARMIRDQRRLAEATVKYGDDSSRTAAAQAMLARSQRDHIDAMIAAEAAHGRLAKAGNETADSVSRMQKLGANPIFNAAGIGSVAAMGIGLVSATDAAGNFQQSLQRLHTVAEESPANLKAISDGVLKLSSVVGYAPQKLMDAALGVEKAGYRGSDAIKVLTASAQLASEEGADLGETISAVTTTMHDYHIPVEQAANVTSKLNVAVGLSKVSLQDFAGALHNVEPVAAGVGESVNDLYASLAMLTQSGMGADQATQNMTHAITSLAKPTQQMSQEMGQLGLDARDIQEHFGERGLIGTANLLYDTIQSKLGPSGMVTLDAWFKSKQVADSANEMFSKLPAQAQAVATAIQNNAEAYKQFRKDRGGLSVEEANLVEQWWNQEKALTGFNNQLKSGKGDVQSMIQALALMVGGQDNLRTVLQLVGENGPKAAAAVKEVSQAQADGAGNTKGFTESQETYNAKMKDFKGALSAARIEIGQDFLPAMTEVVGVLGESAHWLTEHKPLLDAVTVGVGAMGTAWLAIKGYNIASTILSPIGTGLGMLKDKLFSVETQATTASTAMRNMGPAAMAGEAEVLAAADAEVAAEGRVTAAAGEANAALSGGRTGGAGLAAAAGPLGIAAAGSMAANDIFGSLDRRFHTNLFTKLGEIPGSGAWVAGQLFGHAEGGPLHAPGPKGHDSALFWGADGEHVLTHHEVQKMGGHSGVYKFRSDLMNGRIVLGRAGGGALGYGGMAPDVAVASSLAGTPYSQGARDDCSGMVGRVILGAMGLPATNLPTTKNMGQWLAALGFQPGIGGPGSISVGWYDHGPNPNDGHAAMTLSNGENAEAGGSHGNFVIGAGAAGAASSQFDHHMFLPTLYGEGAATGMPGFAAGMGAGGFGGMGGGIPPGATPGTGPGGQPGYYTANPQRVAAAEERLRHLDAEIDNAEKRRSELKATAKQSERDRLDEEIRHLKAERTQEQQRLAEAERGTFHAMHGHRGAGGGENPFLPVPLADQFGLSKGLPGLAEWTVGFLEDLVLGPLETAAWAAIGQAPPGAGGTGGGFGGLSAPGGLGAARFGFPNPAPLAAPPGAAGADDAAAAGLDTARGNTTGQAPSSGGGAGAGGGSEFEFVKSPSKPGLPLGPLARPPAPDSAPPPADYKSWYGQGASDSFYRTWYPTPLGPVPTPSPNAYGPPSHGSDWRWGPVHVAPPAPPGPMKSPLEQQQSMLGGAGSGGPLPSGPKPLPMGPFIGGDPRWGTAHFASGGPSGTDTIPAWLSPHEYVEPSEAVDKYGPGFMDAIRQGRIDPTSVRYYAPGGEVTDQPEPPPQQQAPAQQPQNMVKAPGAPGGPAIEPPPGAPKPGDNASIHEPTGPGAVSPGSKQGLSDTATPGADVQQPGTGQGALPGIGFSGGIIGGLEGAATQAAAMGADMGTFGGAGGAVSSAMNIGFQELNRAAAYGAQDVGIGVEGLLEALIPNSDATGADWSKTIPGRLLMGVTGVRTAGQQNTAGQTQQPFASNASSDQYANVGNTQPQAPIQIMGPVHVQANDPKQLHEGLNSQAAMANSANMIGTQFRGTAGGTG

SEQ ID NO: 4178 - protein, 93 aa, Mycobacterium paratuberculosis
MIAGMPSGIEHLRAMTEEELIAAHDNINSNRALPSSYFLDELRRREAERAELASYKLAAESHNLARRVFWLTVVSTVFAGFAAIVAIIALFLR

SEQ ID NO: 4179 - protein, 83 aa, Mycobacterium paratuberculosis
MNSDIADIAKWARSQGWTVFDDSKGYTRFYNPQGEYITNYPATPSRPNRRMADLKVDLKKAGLPIPPPSKKEQRAQRKKGDTK

SEQ ID NO: 4180 - protein, 172 aa, Mycobacterium paratuberculosis
VTKTDWVITFTFDVDPPIETMDEWESRLDGFDASVARIPDRGVDLTVYAPGDLSMFDALNKTINEVAHVVQSGPPIGLEVVTEREHTRRAEAPSMPELMSAAEIADELGVRRQRVHQLRATSAFPAPLAELRGGAVWDAAAVRKFAQDWQRKPGRPRNSAVDSQQRDYALGH

SEQ ID NO: 4181 - protein, 149 aa, Mycobacterium paratuberculosis
VFAVSGRRPLPRMVQRPTRQTPAARRRSGPAPHPTARPTQKATPHPPQPERHTMTTDNPTPSDDQALAALYATALGVLLAGLVNDGRLTTEIERIIAAGEKVTAGVLGFLTAAAANAYEYEHGSREAAIDAVTADLATVLLAAGEGQPS

SEQ ID NO: 4182 - protein, 396 aa, Mycobacterium paratuberculosis
MVAAQGSSMLTAADFAAQWADVPPWEPPDEPPQRNGQRQQQASAEPTTWEAFDLGPYLRGEIERPHPGIGISRSDGQRSLYPGREHAIVGETESGKTWFALGCAAAELNAGNDVVYIHYEEPDATSTVEKLCLLGVDPAVIKARFRFVAPSRPVREEWLNALLDPSPTLVIHDGVNEAMALHGDEIKAVEGAAAFRRRLILPCLRVGAATLACDHLPMVRDGSRRDAYGSVHKGNALDGARFVLENSAPFGRRLRGVSYVFVTKDRPGHLRANGRATKSPGKTFMGTLVVDDSQAFGPDFTMRFFAPRDDDVPESDPNAELADAVFRVVAAAPDHAVGSMRLLFAELRNVDIQFRDDDVRDVVDDLVVSGRLVEISGKRGAKGFRAVVEDADGDST

SEQ ID NO: 4183 - protein, 158 aa, Mycobacterium paratuberculosis
VTQNRNGPPIEVEGRAPHHRDRPSTSKVGSHATAYNRTTELTAPSAETPGTTNSRQVSWWETHQFIEALITQANTGPLPPAGTPAWSALADGDPRKLLALAVAGEHHVLRVETAQTAMAEASQAVSAAADWTRIGRRNRDHEDIHRQRPWLRRKAPRC

SEQ ID NO: 4184 - protein, 183 aa, Mycobacterium paratuberculosis
MADDNLDYLLPEQREWWLTNAAMPPTLVLRCGIGGCGICVGIVKSDKTDPGVAIALMHHKSGKTTVPHYEPIDDERLAALGLPPATELYDASGITLAEHIQRRQREVDSLTIRSVDKTRRVSRRHADPSVAMPLEWIGYIVCPDHGTVALPDPATTVAAMRGQLIPTTHAKRRTFRIFRGTSV

SEQ ID NO: 4185 - protein, 345 aa, Mycobacterium paratuberculosis
LARDADAKRDKRAFGNIRKLPSGRFQVRYTGPDGSYITAPKTFAAKIDAEAWLTDRRREIDRGLWDVASAKQPERVTFGAYAAGWLAGRQVAGRPIKARTREHYQAILDDHLLPAFGSRQLTSITPKDVREWYSGTLTNRPTMRSHAYSLLRTIMGSAVNDELIDANPCRIVGAGRAKRVHKIRPATVEELPILTEAMPERLRLMVALASWCALRFGETIELQRGDIDLADEVIRIRRAAVRTHGGTFEVTTPKSDAGIRDVAIPPHLVSAIEAHLAKYVGKKRDSLLFPNERGRHLQPSTLNRHWGTKRGPQPAATICVGTTYGTPAQSWPPPPAPASPNSWPG

SEQ ID NO: 4186 - protein, 102 aa, Mycobacterium paratuberculosis
MNAGKPKFCLLPRWRGLGIATDALYVAIDAGISLRCRSADERSEGHAGRRRGRGETHAGIMPRSPRLTTTNRRLKYANSTPTCLCAIRRPHRCTRWRATEPW

SEQ ID NO: 4187 - protein, 185 aa, Mycobacterium paratuberculosis
MRYLQPVTRPARMSTLAAALALTACLTAPGATADPTPQQSPFPTGKSGTTIHVTEYSTATADVTLNSATWVSSGCPGGGGCNVIELTIAGKSDKPFTYSQASITAASTPWRQDPYRDTQGGSSLADYQQLNKTPPLRVGSVTNGQTAHGFIAYDGAIRQGDVYIEFNDPDAPAAPTPLAGWKVHT

SEQ ID NO: 4188 - protein, 425 aa, Mycobacterium paratuberculosis
MTDVDPYIIISADTHAELPTERYREYVDPEYREDFETYLAEKTAAAQAGGFIDEEFAQEWFSEHGEGIAGGWDVALRDKELDGDGVVGEVIFPDADAVTGVAGAPFGAGLGQSGDLDPGRAMAGARAHNRWLAELCSHSPERRAGVAVVPILADVDAAVAEITRAAESGLRGGILIPARWVGYPPYHDRRYDKVWAACQDLQMPVHTHSGPAPQEEYGGHLGIYVTEVRWWGARPLWFALWSGVFERFPGLRWGVTECGAFWANDLLWLMDTRYLREHSAKKMSHLMEGDLTMPPSAYFDRNCFIGATTTERRELARRYEIGVSNILWGNDFPHPEGTWPHTRDWLRRSFWDIPVEETRQMLGLAAAELYNFDLGALAPLAARIGPVPADLGQDDAVSIPKWEAARRTGRHWLTDAEPMPDLVQS

SEQ ID NO: 4189 - protein, 404 aa, Mycobacterium paratuberculosis
MDRYTVISADCHAGADLLDYRDYLDPQYRDEFDGWAKTYVNPFGDLSEPDAERNWNSARRNCELDTEGIAGEVIYPNTVPPFFPHASLAAPPPETARELELRWAGLRAHNRWLADFCSLSPERRAGVGQILLGDLDEAVAEVGQIAKLGLRGGVLLPGIAPGTGIPPLYAEHWEPLWAACAEAGVVVNHHGGNAGPSPTDGWGSSFAVWVYETHWWAHRALWHLIFSGALDRHPDLTVVFTEQGAGWIPATLASLDVAAARYARANSAIARFAGPTAGSLSLKPSQYWARQCYVGASFMRPVECAERHGIGVEKVMWGSDYPHYEGTAPYTREALRHTFSDVPPDEVAAMVGGNAARVYGFDLDALAPLVDRIGPSVAEVAEPLAAVPADASSTVFEPDPIRTW

SEQ ID NO: 4190 - protein, 267 aa, Mycobacterium paratuberculosis
VSSNVIRYGPRPPEAQVDHEIDATKAPIATEAVTVIYLTEPDIVAAVLPKPLQPADEPLVRIQLQRVRIEGMAPFGSAVFSVTARHGDRYGDYPLFMPQSTEQSVTGGRETFGEPKKLAQITVERDGDRVTAGVDRLGYRLIRLSGQVSGRAELPPDQMNTEFYFKFLRAPDGSGITDPHLVYGEYHRHYELLENIDGTLELGESPLDPVADIVIRQVTSITWCRRRTVQVGRIAARVPQEWLLPYVHQRYDDVALLAAPRPEPARA

SEQ ID NO: 4191 - protein, 325 aa, Mycobacterium paratuberculosis
LWCSVRPCDDGHTMTDLQGKVAVITGGAGGIGRALGRRLGHEGMKVVLADVLADPLQEATRALADEGIEAAGVVTDVTDYSSVEALAKEALRRFGAVDVVCNNAGTGAVSEGYLWEHDLADWRWGIDVNVLGVIHGLKAFVPILLERGEGHVVNTCSGNGGFAPIARGAMGGPATAVYPMTKAAVLCLTESLYTHLEMTGTRVRAHVLFPGGFLNTGIWESWRHRPPRYAPTQQRRTPEQTLDKVVARFEAAGARVEFTPLETVADLVVDGIAADRFWMMGPPAPSDDVVRRKAASILSRGAPDYLVDILGRSAGGNSENQGENQ

SEQ ID NO: 4192 - protein, 325 aa, Mycobacterium paratuberculosis; identical to SEQ ID NO: 4191

SEQ ID NO: 4193 - protein, 417 aa, Mycobacterium paratuberculosis
LDRYIVISTDTHAGADLYGYKPYLPARLHDEFDAWAKAYASPFDDLIVATANRNWDHELRIGEMDADGVAAEVLLPNTVPPFFPTTPNITISLPRTRAEFEKRWAGVQAHNRWQVDFCSLAPDRRRGLIQIFPNDVELAMEEIRWGARQDCFGGVLIPPVSPGDSQVAPLFHTHYEPLWALCAELDLTVVQHAGAGSPEMPMDQPASNAVLITEMALWAQRTLGHLILAGVFERYPTLRFVPTEQGTLWVPAQLGVLDAMVPTMKSDAHNRTYGMFGGSSVDALTLTPSEYVQRNCYLASELMPYDGAMIDFMGPDHIMWGSDYPHEEGFAPHSKLAIRWALHDRPEDACRKILGGNAARLYRFDLDKLIPVAAKIGPTVEEVRTPVPDTGYRAPAAFGYRPFEGGLALKRLAPQRG

SEQ ID NO: 4194 - protein, 84 aa, Mycobacterium paratuberculosis
VFRSAGWEQDVRVSWTRYETRALADTSLRGDALHAALEDYIRVQNPQLTDVRLERATATGASGGPPGSRWYQVTYLAEDPDRSA

SEQ ID NO: 4195 - protein, 245 aa, Mycobacterium paratuberculosis
LLRRQRGLLGQPQRQHRHVGVGVDARAHAVAHGDRVVVVEHGDPALGQAGEERVIGFVRGGRCRAQQRGGGQDDRAGGRPRGTTGLGVSHGLPWVRWAESRRLIETIDEFWVTSPRRTPARGHDEQCVALIRPFGAPSLARASESALAASGPEPPRNRPEPRSKATDAAVAGARDHFAGVAGFGGAVRKGELVRLVLTVRGRPAGGASAAHRHRQGDEVVVGPGGLGRPQRRGRASDRDDDDGDE

SEQ ID NO: 4196 - protein, 225 aa, Mycobacterium paratuberculosis
MVTVTAKGPGAPIVSGDPILGIVVDMLDTGGYEAVQLREVARRARVSMATIYKRYRTRDELIVAALEGWMDANRYARLPSLIDELPGESMYSDLMHVMRTIFEPWERHPLMLRSYFQARSGPGGKRLIRRGVEAVVPVAKSVLAQADPGFVNDLELILTGVVFGFLTRFAQGEIEVTEIVPGIERTVYWLTQAYQNADAGRQPHISGGGISQPSEGSTSSLYCGQ

SEQ ID NO: 4197 - protein, 276 aa, Mycobacterium paratuberculosis
VGSLDGKVAFITGVARGQGRSHAVRLAREGANIIGIDICADIAANGYPMACRAELDQTVALVEEAGGKMLGTVADVRDFGQVKAALDAGVEQFGRLDIVLANAGIAPLAFRQLSIEEELAQWRAVTGVNLDGAYHTAWAAIPHLLAGNRGGVIIFTSSTAGIKGFGGLQGGGLGYAASKHGIVGLMRTLADALAPLNIRVNTVHPTAVNTMMATNDDMIEFLQKNPGAGPHLQNPMPVGMLEPEDVSAAIAYLVSDEARYVTGVTFPVDAGFCNKV

SEQ ID NO: 4198 - protein, 273 aa, Mycobacterium paratuberculosis
MATDGATGRVAGKRVLITGAARGMGRSHAVRLAEQGADCILVDICCTPTGLDYPLATEEDLNETVRLVEKHGSRAVPKIVDVRDEAAMKAAVDAAVDELGGLDGAVANAGVLTVGTWDTTTAEQWRLVLDVNLIGAWNTCAAALPHLIGGGGGSLVNISSSAGIKGTPLHLPYTASKHGIVGMTLALANELAAQNIRVNTVHPTGVATGMAPPGMHALIAEQRPDLVPIFLNALPAPLIEASDVSNAVLYLISDESRYVTGLELKVDAGVTIR

SEQ ID NO: 4199 - protein, 273 aa, Mycobacterium paratuberculosis
MPVSRSDSAARHQRGVRTFAEVMTFDPPDDASPCASGLIDFVFGEVWSRPGLSRRDRRFVTLACVAAADAQAPLEQHVYAALNSGDLSITEMREAVLHFAVYAGWPKASRFNIVVDQQWARIAAERGEPAPDPEPLLPLVTAADPEQRLRGGERSFKDINCLPFAPPRDNPYSGAGILNFVFGEMWLRPGLGMKERRLITVACVAFQDAEIPIMSHVYAALKSGDVSFREMDEVALQFAAYYGCAKADHLNQAIAEQKQRVIAENHSDATPVG

SEQ ID NO: 4200 - protein, 487 aa, Mycobacterium paratuberculosis
MTATASSPPRTGALLIGTERITAASGGSHQHRYPGTGVPNATIPLAGHSEVDRAVHSAREAQREWISYPVDRRRDLLFGLADLLRDHFAELTELNVHDYGVPISVAGNSVLTERFVRYYAGYPDKLTGASTPVSGAFDVNIVEREPYGVVAVIAPWNGPLVVAGAAVAPALAAGNAVIFKPSELASLAPLRFGELCLEAGLPPGLVNVLPAGPEGGEALVRHPGVGKVHFTGGHATAQQVLRAASDNVTPVTAELGGKSAYLVFADADLDTAAVIAAHQGPLTQAGQSCACASRILVEASVYVSFVEKLVAQVQAATIGDPLRPDVMLGPVITEAAADRILGVIDRAVAEKAGDLVTGGRRLGGELASGYFIEPTIFSNVDNRSSLAQTETFGPVASVMPFADEAQAVSLANDSRYGLNAFVATANLERAHRVARRLQAGSVWVNRHSDIEPQGPYGGYKQSGFGRTGGVEGLHEFLQVKNIRIGMS

SEQ ID NO: 4201 - protein, 93 aa, Mycobacterium paratuberculosis
VAADPPLPADALHDGNPPAEPHGDGDRFPRGLRPRRVAAAAGGVHGGAENLPPLARRAVRLRAGQVGAPGGGGGLAPGPKHVGALAIPRGAVR

SEQ ID NO: 4202 - protein, 416 aa, Mycobacterium paratuberculosis
MHVINGVRDPAASFPLDTATDDAGERRQANRAVAVSAAGLALTGLVELVIAVVSGSVALLGDALHNLSDVSTSALVFVGFRASRKLPTERYPYGYERAEDLAGIGVALVIWGSAVVAGFESVTKLLRHGGTGHVGWGIAAAVVGVVGNQLVARYKLVVGRRIRSATMVADAKHSWLDALSSAGAVLGLIGVALGWGWADAVAGIVVTGFICHVGWEVTADIAHRLLDGVDPDIVTTAEAVAVSVPGVTHAHARARWTGRTLRVEVEGFLDAATSLSDSDRIGRSVAAPWPRGCRRCRASPGRHARPENPSRPAGFEVSPGRSARAAAGRSPTTGPTRRRRRHRVTRPRRVRRRPRRRAPARRGTWPASAAARTATRPDPRGSTAHRRRWFGPAAGRGPRPGAAQRNTTHRSAIPAR

SEQ ID NO: 4203 - protein, 309 aa, Mycobacterium paratuberculosis
VRVDPGPLTWDTAVQTWHLDPVSAVVVVALAAGYAWCYRRAGASARVAPAAYFAAGLLAWVAATCSAVGTYAYLLFWVRALQVLLLLYVVPFFLAQATPVTMLRDALGPSGRDRLDRLLASPIARVLAHPATTSLGMLATPWLLYLTPWYTAALHNEWVGAPTRILLVALGFGYFYARLQEDPVPRRYPQSISLLITVVEALGDGLLGLVIWQGSLIGASYYAGLHRVWGPDPRLDQTIGAGVLWILGDLVGWPFVLLLMRAMSRDERAHAVAVDAELDEAESHDAGGAAASGLWWENDPQLRERFGRG

SEQ ID NO: 4204 - protein, 161 aa, Mycobacterium paratuberculosis
MHPAGNCRKRCESFAVRRRRQFPRQALPRAGARRDADRRRVWDNRCAMRLFLGLCALAATIGLAAPAHADIDNDQDFLKDLRDAGITYQDAGNAITIGKSVCELLDDGQSDAKIVTDLRNQNPAFQGASAAKFTYLSAAHYCPKYITGEDRGPKPEGAVGN

SEQ ID NO: 4205 - protein, 114 aa, Mycobacterium paratuberculosis
MKLFLIVAGFAAVIGLAVPARADSTDDAFVASLDKAGIKYGDADKAAGAGKWVCTTLQGGKQMSDVVSTLQSKNSNLSDDHANTFAAIAVNAYCPDQASSITPATPTDTPPSTS

SEQ ID NO: 4206 - protein, 250 aa, Mycobacterium paratuberculosis
MSEPIRIVHPVRLDELIDAIKTTHPDVLDQLADAVLAAEHLGEVADHLIGHFVDQARRSGASWTDIGKSMGVSKQAAQKRFVPREATILDPGQGFQRFTPRARGAVVAAQNAAHQAGNREITPDHLLIGVLSDPAALATVLLRLQHVDTDALRDAATAAIAALRADGDPPALIPFSGPARKVLELTVREALRLGHNYVGTEHQLLALLELEDGDGPLHRGGVDKERVEVDLIRALESLGNGKNVGAGEDG

SEQ ID NO: 4207 - protein, 175 aa, Mycobacterium paratuberculosis
MRRWLRVVSAFLIGFPVAAAGVGAVPLPRAWAGDAPIGHIGDTLRVDNGTFIADVTVSSVAPCDPPPGFGYTREGTYKGFPGSTVDRADVTIRAIRVPNPYILATVFSFNGVTPNADAYKPRASDAPDALDNVLVNAPNGAIVRGGVYWDAYRDPVSNVVLLDKKTGYHLAQWNL

SEQ ID NO: 4208 - protein, 173 aa, Mycobacterium paratuberculosis
LTPAPATHAVRIITTESVDVQQLADLAARTFPLACPTSAAREDIAAFIDANLSAECFARYLADPHRAILAAELDGRIVGYAMLIHDLAGDAAELSKIYVAPEQHGAGTAAALMRLAVDTAGRWGVSRVWLGVNQKNQRAQRFYAKHGFTVSGTRTFQLGAGREDDYLMSRTLR

SEQ ID NO: 4209 - protein, 373 aa, Mycobacterium paratuberculosis
MRLIAARGYSACMHGSGSASASAGVAHLVDRHPTVSPQRLIAQLRPPPTFADVSFATYQPDPAEPTQATAVAACREFCRQAVQRRAGRRKLLGRREILPGVGLYLDGGFGVGKTHLLASAYYELPGDGPVRSPDGPAPKAFATFGELTQLAGVFGFAECVDLLADYTAVCIDEFELDDPGNTTLVARLLSSLVERGVSVAATSNTLPEQLGEGRFAAQDFLREINTLASIFTTVRIEGPDYRHRDLAPAPPPLSDAQVAARAAVVPGATLDDFDALCAHLATMHPSRYLTLIEGVTAVFLTGVHRIDDQNVALRLVSLTDRLYDAGVPVLASGEKLDTIFSAEMLSGGYRKKYLRAMSRLLALTAGANEAYGS

SEQ ID NO: 4210 - protein, 261 aa, Mycobacterium paratuberculosis
PRAAIRRMALPETPLSLLGSVREVDDGELPGLYDYPDGHAGTWVRANFIASVDGGATADGSSGAMGGPGDRFVFNLLRELADVIVVGAGTVRIEGYSGAQLGVAQRQQRQARGQSEVPPLGIVTKSGHLNRDMAVFTRTEVPPLVLTCAAAADQTRRLLSGLCEVLDCSAGDPERVDEATMLALLGKRGMRRILTEGGPTLLNSLLERQLLDELCLTIAPYLVGGHARRIATGPGQLLTRMRCAHVLTDDAGYLYTRYVRC

SEQ ID NO: 4211 - protein, 526 aa, Mycobacterium paratuberculosis
VLATVVGMSRPHPCATILVAVTALLAGCVPGLAADPRFATNSGARPQGAATSKPAPGGPPPLAAPKNDLAWHDCTSRVFADAAVPPAPGIQLDCANYDADLDPVNGGGGALSIGVVRARSNQTPRDAGPLVFTTGSDLPSSAQLPVWLSRAGADVLAAHPIVAVDRRGIGMSSPIDCRDKFDRQQMRDQSQFQAGDDPVANLSEVANTATTNCTDAIAPGASAYDDAHAASDIERLRSTWDVPALALIGIGNGAQVALAYAGSRPDKVARLILDSPVALGVNAEAAAEQQVKGQQAALDAFAAQCIAVNCALGPDPKGAVSALLADARAGKGPGGVSVAQVANAITVALGFPSGGRVNATTDLANALASARSGDTNALNNLINHANAMQDSDGQFVNVCSDAVNRPTPDRVRELVVAWGKLYPQFGTVAALNMVKCVHWPTGSPPPSPKSLKVDVLLLGVQNDPIVGTDGVAATAAGIINANAASKRVMWQGIGHGASIYSGCAVPPLIGYLGSGKLPNTDTYCPA

SEQ ID NO: 4212 - protein, 428 aa, Mycobacterium paratuberculosis
VYGALVTAAESTGLRDWIQAAFRPRTSAPSVATVLRSALWPIAIFSVLHRSIVVTTNGNITDDFKPVYRAVLNFRRGWDIYNEHFDYVDPHYLYPPGGTLLMAPFGYLPEYPSRYLFILINTVAILIAWYLLLRLFGYTLSSVAAPALLLAMFCTETVTNTLVFTNINGCVLLAEMLFLRWLLDGRVGRQWWAGVAIGLTLTLKPVLGPLLLLPLLNRQWRALVPAFAIPILINAAAWPLVSDPMDFVTRTLPYIGGVRDYFNSSIEGNGVYFGLPTWLIVFMRILFTLIAIGALWLLYRYYRTRDPRFWFTNSAGVLLLWSWLVLPLAQGYYSMMLFPFLMTVVLPNSLIRNWPAWLGIYGFMTLDRWLLFNWMRYGRALEYLKITYGWSLLLIVVFSVLCYRYLDAKAEDRLDRGIDPAWLTAGRE

SEQ ID NO: 4213 - protein, 134 aa, Mycobacterium paratuberculosis
MTSPKVQLTDDEWRQRLTPEEFHVLRQAGTERPFTGEYTDTKTEGVYQCRACGAELFRSTEKFESHCGWPSFYDPANSDAVILRPDHSLGTTRTEVLCANCHSHLGHVFTGEGYPTPTDQRYCINSICLRLAPS

SEQ ID NO: 4214 - protein, 282 aa, Mycobacterium paratuberculosis
VDDAFVGSDAVRRGTLSRHRLRAQFRAIYPDIYLPAHAARSLRTRSVAAWLWSGRRGVLAGLAAAALHGSSWIDDDEPIELIWRNPHPPAGVITRNQRLEPDEITRVAGLPVTTPARTAFDLARQRPRGEAVARLDALMRATPFSTAEVLMLAERRPRARGLRKLRAALPLVDPGAASPKETWLRLLLIDAGIPVPATQIPVQQNWRLIAVLDMGWEDYLVAAEYDGDHHRTNRRQYARDQARLRTLQKLGWIVVRVIAEDKPDDVVRRTRDALTRRGYRDT

SEQ ID NO: 4215 - protein, 250 aa, Mycobacterium paratuberculosis
VTASFDPADPARFEEMYRDQRTSHGLPAATPWDIGGPQPVVRQLVALGAVKGEVLDPGTGPGHHAIYYASQGFSATGIDGSAAAIERARANARKAGVSVNFELADATKLDGFDGRFDTVVDCAFYHVFATEPELRSSYARALHRATKPGARLYMFEFGEHDVNGFKMMRSLSENDFRDVLPAAGWEISYLGPTTYQVNLSAETIQMMAARNPDMADEAAKLLERFRAMEPWLQGGRVHAPFWEVHATRVD

SEQ ID NO: 4216 - protein, 231 aa, Mycobacterium paratuberculosis
MAKLDYDALNSAIRYLMFSVFAVRPGALGDQRDEVVDDASRFFKQQEERGVVVRGLYDVAGMRADADFMIWTHAETVEALQATYADFRRTTALGRVCSPVWSSVALHRPAEFNKSHIPAFLAGEEPGAYICVYPFVRSYEWYLLPDEERRRMLAEHGMAAREYKDVRANTVPAFALGDYEWILAFEAPELHRIVDLMRELRATDARRHTRAETPFFTGPRVPVEQLVNSLP

SEQ ID NO: 4217 - protein, 451 aa, Mycobacterium paratuberculosis
MTARSYCVVGGGISGLTAAYRLRVAAGDDAVITLLDPAPQLGGILRTEPVGGVPMDLGAEAFVLRRPELPALLSEVNLTGRQRVSTGARPLIYSRGRLHPLPTGTVVGIPSSAASMARLVDEATLARIDAEPRRPLHWRPGSDPAVADLVGDRFGEQVVSRSVDPLLSGVYAGSAATIGLRAAAPTVAAALDRGAASLTDAVRRALPPATGAPVFGALDGGYRVLVDELVARARPRRVRAAAARLEPAGPGWAVVDDAGARRHADAVILAVPAREVARLLAGIAPRSAAAAGRVVAASSVVLALAVPGDTAFPDCSGVLVATGERLRAKAITLSSKKWGTRADVQLLRLSFGRFGDQVAARTPDEELRGWALADLAAVFGLDVRPVDVRVQRWLDAMPQYGPGHAELVGELRAGLPPTLAVAGGYLDGIGVPACVGAAGRAVEALQAEVAP

SEQ ID NO: 4218 - protein, 357 aa, Mycobacterium paratuberculosis
MNSSARTRRDLPESPYLAAVNGRKPHRVPVWFMRQAGRSLPEYRALRAQHDMLSACFDAELVCEITLQPVRRHDVDAAILFSDIVVPLLGAGIDLDIVAGVGPVIASPVRTAADVAAMKPLERQRVQPIADAVRLLVSALVEVPLIGFAGAPFTLASYLIEGGPSRHHARTKAMMLADPDSWHALMEKLTDITVGFLRVQLDAGVDAVQVFDSWAGALSLANYRSYVQPHSARVFAALADYGVPMTHFGVGTAELLGAMSAALKPAPATVVGVDWRTALADAATRVMPGTALQGNLDPVVLLAGWPVVETAARAVVDDGRRAVDAGAAGHVFNLGHGVLPETDPGVLTELVSLVHSL

SEQ ID NO: 4219 - protein, 258 aa, Mycobacterium paratuberculosis
LRCELGDDGVLTVVLDSPGLNSVGPQMHRDLADIWPVIDRDPAVRAVLVRGEGKAFSSGGSFDLIDETIGDYQGRVRIMREARDLVHNMINCDTPVVSAIRGPAVGAGLVVALLADISVAGRTAKLIDGHTKLGVAAGDHAAICWPLLVGMAKAKYYLLTCETLLGEEAERIGLVSLCVDDDDVLSTAAGIAGKLAQGAQHAIQWTKRSLNHWYRMMGPTFETSVGLEFLSFSGPDVQEGLAAHREKRAARFTGGSAT

SEQ ID NO: 4220 - protein, 211 aa, Mycobacterium paratuberculosis
VTRAVTMQNGRDEQERRQVTSSEPAPFREAVAAMNAVVMRPEIELGPIRPPQRLAPHSYALGAEVKHPDREIIPERSDGDAFGRLILLYDPEGADAWDGTIRMVAYIQADLDPSEAVDPLLPEVAWSWLVEALESRMEHVVALGGTVTATTSVRYGDISGPPRAHQLELRASWTATSPAVGAHVQAFCEVLEHAAGLPPAGVTDLSSRSRA

SEQ ID NO: 4221 - protein, 435 aa, Mycobacterium paratuberculosis
ARGHAPSMGEPSAEGPGSGVPAPIPLPHPSEGVPPISASVPDIEDAARRLDRGRGPFAVDAERASGFRYSNRAYLIQIRRAGAGTVLIDPVSHGADPVRALRPVAEVLGSDEWILHSADQDLPCLAEVGMRPPALYDTELAGRLAGFERVNLATMVERLLGFGLAKGHGAADWSKRPLPAEWLNYAALDVELLIELRAAIADVLAEQGKTDWAAQEFDYLREAGSKEPGPAARRDRWRRTSGIHRVRDQRGLAAVRELWLTRDRIAQRRDIAPRRILPDSAIIEAALANPTTIEELVALPVFGGRNQRRSAATWLAALDAARQSENPPVDSEPPNGPPPPARWSRRKPEAAARLEAARAALAEVSERVHVPTENLVAPDLVRRLCWDWEPTPDPFAAVDAFLCAGHARPWQRELVDPVLARALQQPLPAVADDDG

SEQ ID NO: 4222 - protein, 641 aa, Mycobacterium paratuberculosis
MLEQIRGPADLQHLSTHQLRELAAEIREFLIHKVAATGGHLGPNLGVVELTLALHRVFDSPHDPIIFDTGHQAYVHKMLTGRAHEFESLRKKGGLSGYPSRSESEHDWVESSHASAALSYADGLAKAFELSGHRNRHVVAVVGDGALTGGMCWEALNNIAASGRPVIIVVNDNGRSYAPTIGGVADHLATLRLQPAYEQALQRGRDALRALPLVGKFAYRVMHSVKAGIKDSLSPQLLFTDLGLKYVGPVDGHDERAVEAALRHARGFGRPVIVHVVTRKGMGYAPAEDDEADQMHSCGVIDPVTGQATKVAGPGWTATFSDALIGYARKRRDIVAITAAMPGPTGLTPFGQQFPDRLFDVGIAEQHAMTSAAGLAMGGMHPVVAIYSTFLNRAFDQIMMDVALHRLPVTMVLDRAGITGSDGASHNGMWDLSILGVVPGMRVAAPRDAARLREELGEALDVDDGPTALRFPKGDVGEDIPAIERRGSGLSGVDVLALPASGCNHDVLLIGVGAFAPMALAVARRLADQGIGVTVVDPRWVLPVSDSILELAARHKLVVTCEDNGVNGGVGSAVSAALRRAELDVPCRDVGLPQRFYEHASRGELLADLALTDQDIARRITGWVAALGSGVAEAEIREHLD

SEQ ID NO: 4223 - protein, 160 aa, Mycobacterium paratuberculosis
LINVAGARRIVLGMRAAELAEDFPVVSVDSDALDATRLLAEHRLPGIVVTDASGKPFAVLPASQVVRFIVPRYVQDDPSLAGVLNESVADRCAEKLRGKTVRDVLPDHLVDVPPADADDTIIEVAALMARLRSPLVAVVKDGRLIGVITASRVLGAALRP

SEQ ID NO: 4224 - protein, 429 aa, Mycobacterium paratuberculosis
MSVIAIAVFVVAYALIASDRVNKTFVALAGAAVVITLPMIRSDDVFYSRETGIDWDVIFLLLGMMIIVSVLRQTGVFEYVAIWSAKRARGSPLRVMILLVLVTALASALLDNVTTVLLIAPVTLLVCDRLAITAAPFLMAEVFASNVGGAATLVGDPPNIIIASRGGLSFNDFLVHLAPIVVIVVGVLIALLPRLFPGAFTVDPERVADVMSLEEKEAIRDPRLLVTCGVVLLAVFAAFIAHGPLHLEPSLVALLGAGILVVASRLQPADYLSGVEWDTLLFFAGLFVMVGALVKTGVVKHLARLAITATGGNTLTATMVILVASVVISGIVDNVPYAATMAPVVADLVPALGDHANPAVLWWSLALGTDFGGNLTAIGASANIVLLGIARRADNPISFWEFTRKGVVVTAVSVALSALYLWLRYFVWG

SEQ ID NO: 4225 - protein, 361 aa, Mycobacterium paratuberculosis
LTRPGPPPVGELTLTTGSPANGGSCVAHHEGRVVFVRYALPGERVRVRVTADRGSYWHAEVLDVIEAADGRIESLCPIAGVDGAGCCDLAFVRPEAARALKAAVVANQLERLGGHRWAGEAEPLGNTGPTGWRTRVRLDVGADRRPGFHRYHSEELVTDLRCAQLPPGMLDGIAETQWPSAAQLHVAVDDDGARHVVRTLRQGRRTATKVIEGRYEAVQRVSGRSWRVPVTAFWQAHRDAAATYRALVLDWAQPGAGMTAWDLYGGAGVFAAALGEAVCASGRVLSVDTSRASTRAARAALADLPQVQVVTDSVRRALAAQRTPALQADVAVLDPPRAGAGREVIDSLAAAGPASSTSVVR

SEQ ID NO: 4226 - protein, 664 aa, Mycobacterium paratuberculosis
VSKLSTATRRLLIGRPFRSDRLSHTLLPKRIALPVFASDALSSVAYAPEEVFLMLSVAGVSAYALTPWIGLAVAAVMLVVVASYRQNVHAYPSGGGDYEVVTTNLGETAGLVVASALMVDYVLTVAVSTASAMANIGSAVPIVAEHKVFFCVAAILLVMALNLRGVRESGVAFAIPTYAFIIGVLTMIGWGLFRIFVLGNPLRAESAGFEMHAQHGQIVGFALAFLVARSFSSGCAALTGVEAISNGVPAFQKPKSRNAATTLLMLGGIAVTLLMGIIVLAEKIGVKLVEDPATQLSGTPPGYYQKTLVTQLAQAVFGGFHIGFLLIATVTALILVLAANTAFNGFPVLGSILAQHSYLPRQLHTRGDRLAFSNGILFLSGAALLAIIAFRGEVTALIQLYIVGVFISFTLSQIGMVRHWTRLLRTETDPAARRKMMRSRAVNTVGLLSTGAVLLVVLVTKFAAGAWIALFAMSLLFGIMKMINRHYNTVNRELAEQAADQDDVVLPSRNHAVVLVSKLHLPTLRALAYARATRPDVLEAVTVSVDDAETRDLVHKWEEADISVPLKVIASPYREITRPVLEYVKRAREESPRTVVTVFIPEYVVGHWWEQVLHNQSALRLKGRLLFTPGVMVTSVPWQLSSSERRKTLEPHMAPGDARRGIFD

SEQ ID NO: 4227 - protein, 221 aa, Mycobacterium paratuberculosis
VRVVVMGCGRVGSSVADGLSRIGHDVAVIDRDSTAFNRLSPEYAGERVLGQGFDRDVLLRAGIEEADAFAAVSSGDNSNIISARLARETFGVKRVVARIYDAKRAEVYERLGIPTIATVPWTTDRLLNALLRETQTAKWRDPTGTVAVSEVVLHEDWIGHRVTDLEQATGARVAFLIRFGSGVLPEPKSVIQAGDQVYVAAISGRAAEAAAIAALPPSEDL

SEQ ID NO: 4228 - protein, 218 aa, Mycobacterium paratuberculosis
MKVAVAGAGAVGRSVTRELLANGHDVTLIERNPDHVDVDAIPAAHWRLGDACELSLLESVQLQEFDVVVAATGDDKANVVLSLLAKTEFAVPRVVARVNDPRNEWLFTDAWGVDVAVSTPRMLASLIEEAVAVGDLVRLMEFRKGQANLVEITLPDDTPWGGKPVRRLQLPRDAALVTILRGPRVIVPEEDEPLEGGDELLFVAVAEAEEELQKLLLG

SEQ ID NO: 4229 - protein, 213 aa, Mycobacterium paratuberculosis
MTANRINPERLLAQAGGVSGVIYSSLPVVVFVIASSVSGLVAAIAAALGVAALVLLWRLVRRDSPQPAISGFFGVALCALIAYVVGESKGYFLLGIWMSLLWAVVVAASVLIRRPLVGYAWSWAGGRGDGWRSVPRAVYAFDVASLCWVLVFAARFVVQGLLYDADRTGWLAAARIGMGWPLTVLAALPTYAAIKSAQRAIAAVELASGAAGE

SEQ ID NO: 4230 - protein, 150 aa, Mycobacterium paratuberculosis
LARGNQEVYGVRWHKWKRRGLSALSGVAMGAQGYLRRLTRRLTEDPEQRDSEELSDEVASTGAQRAIDCERGQEVTMVGTLRSVECNGRACAGGVRAELFDGSDTVTLVWLGQRRIPGIDSGRTLRVRGRLGKLENGTKAIYNPHYEIQR

SEQ ID NO: 4231 - protein, 232 aa, Mycobacterium paratuberculosis
VVVDLRGVRAVLLPGTGSDDDYIHRAFSGPLAGVGAVLVAPPPRPDRLVAGYLEALNDAARRGPIAVGGVSIGAAVAAAWALAHPDRAVAVLAALPAWAGAPEEAPAALAARYSAARLRADGLAATTIQMRASSPAWLADELTRSWGAQWPHLPDAMEEAAGYVAPSRDELAGLTAPLAVAAALDDPIHPLQAGRDWVAAAPRAALRTVTLDQIGADPAALGAACLAALAEL

SEQ ID NO: 4232 - protein, 257 aa, Mycobacterium paratuberculosis
MAVFGRRARRGDEDTPVGAEIPEPDPVVAHDDADEQAADELEGPFDIDDFDDPAVAELARLDLGSVLIPMPEAGQLQVELTETGVPSAVWVVTANGRFTIAAYAAPKTGGLWREVAAELAESLRNDSAKVSIQDGPWGREVVGTAAGVVRFIGVDGYRWMIRCVVNGTHETMEALEQEARAALADTVVRRGDTPLPVRTPLPVQLPEPMAQQLREAAAAQQAAAQQAQSQQSPGNEPAARRSADGSAMQQLRTTTGG

SEQ ID NO: 4233 - protein, 154 aa, Mycobacterium paratuberculosis
VSTSLAIVRLDPGLPLPSRAHEGDAGVDLYSAEDVRLEPGRRALVRTGVAVAIPFGMVGLVHPRSGLAARVGLSIVNSPGTIDAGYRGEIKVALINLDPAEPIVVHRGDRIAQLLVQRVELVELVEVSSFDEAGLAGTSRGDGGHGSSGGHASL

SEQ ID NO: 4234 - protein, 161 aa, Mycobacterium paratuberculosis
VSDTRVAPHNVRYRERLWVPWWWWPPAFALAGIIAFEFNMGVTRQSSWWPYAALFAVAAAALLWLGRIEVRVTADPAAPGEVELWAGPAHLPVTAIARSAPVAPSAKSAALGRQLDPAAYVLHRAWVGPMILVVLDDPDDPTPYWLVSCRHPERVLSALRG

SEQ ID NO: 4235 - protein, 100 aa, Mycobacterium paratuberculosis
MPTDYDAPRRTETDDVSEDSLEELKARRNEAASSVVDVDESESAESFELPGADLSGEELSVRVIPKQADEFTCSSCFLVQHRSRLASEKNGVMICTDCAA

SEQ ID NO: 4236 - protein, 222 aa, Mycobacterium paratuberculosis
VVTQITEGTAFDKHGRPFRRRNPRPAIVVVSLLAVATAVIWTVALTRPAKVHEAAVCNPPPKSTGPAGSTASAPAQLGEQVSRSAMMDVTPAKLADTKVRVLNASGRGGQAGDVAGAMKDLGFAQPTAANDPLYAGTRLTCQGQIRFGTAGQATAAAVWLVAPCTELFNDNRADDSVDLALGTDFTALAHNDDIDAVLATLRPGATEPSDPTLLAKIHASSC

SEQ ID NO: 4237 - protein, 292 aa, Mycobacterium paratuberculosis
VMPSDDELVRLRSVAETLAAEAAAFVRRRRAEVFGTEPGGASAPDGGAVRSKSTPTDPVTVVDTETERLLRDRLAQLRPGEPILGEEGGGPAEPSPPGDGTVTWVLDPIDGTVNFVYGIPAYAVSVGAQVDGESVAGAVADVVGDRVYSAAAGLGAHVSDGAGRQPLQCAAVDDVSMALLGTGFGYARQRRAAQAALLARMLPVVRDVRRIGSAALDLCMVAAGRLDAYYEHGLKVWDRAAGALIAAEAGARVVLPAPDGDGAGLVLAAAPGIADELLAVLERFDGLDPILD

SEQ ID NO: 4238 - protein, 268 aa, Mycobacterium paratuberculosis
MTSTDSTAHTPAAPAAGPPPRRGFGVDVGGSGIKGGIVDMDTGLLIGERVKLLTPQPATPSAVAKTIAAVVDAFEWTGPLGVTYPGVVTHGVVQTAANVDKAWIGTNARDIISAELNGQEVTVLNDADAAGLAEEHYGAGRNQSGLVVLLTFGTGIGSAVIHNGTLIPNTELGHLEVGGKEAEQRAASSVKERHGWSYEKWAKQVTRVLVSIENALWPDLFIAGGGISRKADKWLPLLENRTPVVAAALLNTAGIVGAAMAATSDVTH

SEQ ID NO: 4239 - protein, 509 aa, Mycobacterium paratuberculosis
VAATKASPATDGPVKRTATKSPSSPAKRPAAKAANGSAPAKRATKTASRSAKSEAGAAAEPAKKTRSSAKGADAKAPSARGTKAAKGGPADPDALDTDGAVEDLDTEPDLEGEPGEDLDIDTDLNLDDLEEDVAADDADIEPGDAEEGEDEEAAAPKAAGATVADEDDEIAEPSEKDKASGDFVWDEDESEALRQARRDAELTASADSVRAYLKQIGKVALLNAEEEVELAKRIEAGLYATQLMSEMAERGEKLPAAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDPGREPTPEELAKEMDITPEKVLEIQQYAREPISLDQTIGDEGDSQLGDFIEDSEAVVAVDAVSFTLLQDQLQSVLETLSEREAGVVRLRFGLTDGQPRTLDEIGQVYGVTRERIRQIESKTMSKLRHPSRSQVLRDYLD

SEQ ID NO: 4240 - protein, 135 aa, Mycobacterium paratuberculosis
MSTSRTVVQSDSAFESDVGYARAVRVGPHVWVAGTTGAGPAGDIAAQARDALRRIEIALHQAGAALADVVRNRIYVTDISRWREVGAVHAEVFGAIRPAATMVEVSALIAPELLVEIEADAYVATGGKPPSGPGR

SEQ ID NO: 4241 - protein, 229 aa, Mycobacterium paratuberculosis
VLVGVVLAEEKLQSGRQLGAHPSRGTAAIAAVGSGQFGTRQSCIHGFSVLVHSLSQTYGVFALFPDRYRVCRFSRPGQVWFGGVSRVAVVTVSPGVLVHLCGAKQWARARRRGRIDPQDADFIHLSTPQQVHLPANRLYRGRDDLVLLHVDPDRLAAPLLWEPGVPTDPASMLFPHLYGPLPVSRCDRGHRLPAGTRRRLPARRHVGVGFDLHQQLGRDQRRDLDHGGR

SEQ ID NO: 4242 - protein, 333 aa, Mycobacterium paratuberculosis
MSDQVAKPSRHHIWRITLRTLSKSWDDSIFSESAQAGFWSALSLPPLLLGLLGTLAYVAPLFGPDMLPSILRQLISTAHSVFSPSVVNEIIEPTVRDIANNARGEVVSLGFLISLWAGSSAISAFVDSVVEAHDQTPLRHPVRQRFFALFLYVVMLVGVVATAPLVVVGPRKVGEHIPLGLSNVLRYGYYPALIVGLTIAVMILYRVALPEPLPSHRLILGAMLATTVFVTATLGLRFYLRWITSTGYTYGALSTPIAFLLFAFFGGFAIMLGAELNAAVQEEFPAPKTHAHRLRTWLFSRSPALERTVQTLASPIANPATQRREVAPAEPRG

SEQ ID NO: 4243 - protein, 79 aa, Mycobacterium paratuberculosis
MQTQTIERTETDERVDDGTGSDTPKYFHYVKKDKIAESAVLGNHVVALCGEVFPVTRAAKPGSPVCPECKQIYDRLKKG

SEQ ID NO: 4244 - protein, 153 aa, Mycobacterium paratuberculosis
VWDSGGMKHGSDSGFDGGFDDFDRNKSRPVLITAAAPSYEEQHRARVRKYLTLMAFRIPALILAAVAYGAWHNGLISLAIVAASIPLPWMAVLIANDRPPRSPDEPRRFDNARRRTPLFPRAEQAALEPPPAAQARWQPGGWDGIDRDRPPFH

SEQ ID NO: 4245 - protein, 332 aa, Mycobacterium paratuberculosis
LNPMTVQAEREVAMANASTSRFDGDLDAQSPAADLVRVYLNGIGKTALLNAAGEVELAKRIEAGLYAEHLLETRKRLGENRKRDLEAVVRDGQAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQNLGREATDEELAAESGIPIDKINDLLEHSRDPVSLDMPVGSEEEAPLGDFIEDAEAMSAENAVIAELLHTDIRSVLATLDEREHQVIRLRFGLDDGQPRTLDQIGKLFGLSRERVRQIERDVMSKLRNGERADRLRSYAS

SEQ ID NO: 4246 - protein, 189 aa, Mycobacterium paratuberculosis
LTAWAISCGRVTFSWPGMTIVTPAGPVSTVTRALGTTPASLSREIRSMSPWTCSVSWRTTTATGAPDGNSVSRTRLASSAPDSGPTPRSSSPGIGLPNGEVVGLFSTLTRRRSTSSLITCSQRHASACTSSQGSRMTSTSSRSASRCLRITATASARPLSVSSRWRSPATCSSPSRSIRDTVWLTVGPL

SEQ ID NO: 4247 - protein, 353 aa, Mycobacterium paratuberculosis
MTTHRQPDFTLSRPGALIAALPAVLGFVPESSLVLVSLEDGRLGSVLRVDLSDELAHRVDHLAEVTAAARPEAVIAVIVDAAGAPCPSCNEDYRQLCDALLEALARNDIELYAAHVVDRVALGGRWHCVDGCGASGLIDDPSASPLAAAAVLDGRRLYARRADLQAVIAVEDPERSAALTAAVRRQAGRRTAALRANPVRRTRGDVEKAMAAAARVSSGEALSDTELARLGCALSDPQVRDMLYALAVGEGADEVESLWAVLARTLPEPWRVEALVLVAFSAYARGDGPLAGVSLVEALRCEPGHRMAGMLDTALQSGLRPEDIRDLARTGYRLAKQFGVRLPPRRPFGRRAG

SEQ ID NO: 4248 - protein, 471 aa, Mycobacterium paratuberculosis
MSSPQEYDMVVIGSGPGGQKAAIASAKLGKSVAVVERGQMLGGVCVNTGTIPSKTLREAVLYLTGMSQRELYGASYRVKEKITPADLLARTQHVIGKEIDVVRNQLMRNRIDLLIGHGRFVDPHTIEVEDPSRREKITISGKYVVIATGTRPARPSGVEFDEDRVLDSDGILDLKSLPTSMVVVGAGVIGIEYASMFAALGTKVTVVEKRDDMLDFCDPEVVEALKFHLRDLAVTFRFGEEVTAVDVGSAGTVTTLASGKQIPAETVMYSAGRQGQTDHLDLHNAELEADNRGRIFVDDNFQTKVPHIYAVGDVIGFPALAATSMEQGRLAAYHAFGEASDGITELQPIGIYSIPEVSYVGATEVELTKDAIPYEVGVARYRELARGQIAGDSYGMLKLLVSTQDLKVLGVHIFGTSATEMVHIGQAVMGCGGTVEYLVDAVFNYPTFSEAYKVAALDVMNKVRALNQFRR

SEQ ID NO: 4249 - protein, 278 aa, Mycobacterium paratuberculosis
MMKAMRVPILMLCSVVGVAASLTSCHRPVEHVSGAPVSAPRVGGPVQRLSQPEQKAVAGPVEPDRRIGAIFIDGGPLHVCTGSVLHSVAGNLIITAAHCLAGASLITFVPGFAGDAAPGPADVWKADAVYLDPRWTNGKDPHADYAVARVSNDSGAAVESRVGLALTLGVTPPPGSRVTVLGYPAGVGGSPIGCQAATSVTDTGFPALACEGLVDGTSGAPWVSGTTVVGLIGGLERGGCAANMSYSAPFDAQTAELLARAEAGGPGDPIPNDLQDAC

SEQ ID NO: 4250 - protein, 323 aa, Mycobacterium paratuberculosis
MTHRQDAGDQYQPGQAGMYELELPAPQLSTSDGRGPVLVHALEGFSDAGHAIRLAAKHLKAALDSELVASFAIDELLDYRSRRPLMTFKTDHFTHYDDPELSLYALRDSVGTPFLLLAGLEPDLKWERFITAVRLLAERLGVRQTIGLGTVPMAVPHTRPITMTAHSNNPELIKNFQPWIAEIQVPGSASNLLEYRMAQHGHEVVGYTVHVPHYLTQTDYPAAAQALLEQVAKTASLELPLTALSEAAEVIRAKIDEQVEASAEVAQVVAALERQYDAFIDAQENRSLLTRDGDLPSGDELGAEFERFLAQQAEKKFDDDDQA

SEQ ID NO: 4251 - protein, 343 aa, Mycobacterium paratuberculosis
MTERKRKNTLRPVREVSAPRLEFRTIHGYRRAYRIAGSGPAILLIHGIGDNSTTWNTVQAKLAQRFTVIAPDLLGHGQSDKPRADYSVAAYANGMRDLLAVLDIERVTIVGHSLGGGVAMQFAYQFPHLVERLILVGAGGVTKDVNFVLRWASLPLGSEAIALLRLPLVLPAVQLMGRVLGTALGSTGLGRDLPNVLRILDDLPEPTASTAFSRTLRAVVDWRGQIVTMLDRCYLTEAIPVQIVWGTKDVVVPVRHAWMAHAAMPGSRLEIFEGSGHFPFHDDPARFIDVVERFIDSTEPAAYDQEALRRLLRSGGGAQAVTGPAPTRVAVLSAMGSDERSAT

SEQ ID NO: 4252 - protein, 161 aa, Mycobacterium paratuberculosis
MPTDLHPDLAALAPLLGTWTGRGSGKYPTIQPFDYLEEVTFSHVGKPFLAYAQKTRAAADGKPLHAETGYLRVPQPGRLELVLAHPSGITEIEVGSYAVTGGLIEMRMSTTSIGLTPSAKEVTALARWFRIDGDELSYSVQMGAVGQPLQDHLAAVLHRQR

SEQ ID NO: 4253 - protein, 154 aa, Mycobacterium paratuberculosis
MHCPFCRHPDSRVIDSRETDEGQAIRRRRSCPECGRRFTTVETAVLAVVKRSGVTEPFSREKVISGVRRACQGRQVDDDALNLLAQQVEDTVRAAGSPEVPSHEVGLAILGPLRDLDEVAYLRFASVYRSFESADDFEREIQALREHRGVATPG

SEQ ID NO: 4254 - protein, 170 aa, Mycobacterium paratuberculosis
LTGGTQMTVIHTLAPRPSSLRRPVNGPVQGVRYGRDGLTRPRRPGQVRPAGAATRYHGTGVAMSVAPHRRRSVTWVTTVGLALAAGAITLWLGLVANVGQVLNGDAPSSAAHVPDRLAVVRVDPGESLSDVAHRVAPDAPAAQVADRIRELNDLNSPTLVAGQTLIAPVG

SEQ ID NO: 4255 - protein, 217 aa, Mycobacterium paratuberculosis
LHAVDPSLTERQRTILNVIRSSVTSRGYPPSIREIGDAVGLTSTSSVAHQLRTLERKGYLRRDPNRPRAVDVRGVDDDVAAPATEVAGSDALPEPTFVPVLGRIAAGGPILAEEAVEDVFPLPRELVGDGTLFLLKVVGDSMVEAAICDGDWVVVRQQHVADNADIVAAMIDGEATVKTFKRAGGQVWLMPHNPAFDPIPGNDATVLGKVVTVIRKV

SEQ ID NO: 4256 - protein, 786 aa, Mycobacterium paratuberculosis
LEQSNASPATRRIVSGSFPRAIAARSPETQYGRRRKGSHARRLEGLVKVHRGRMRKLVGSALVSLTTTALAAVLLAPAATASPIGDAEAAIMAAWEKAGGDTSPLGARKGDVYPVGDGFALDFDGGKMFFTPATGAKFAYGPILDKYESLGGPAGSDLGFPAINEVPGLAGPDSRVVTFSASDKPVIFWTPEHGAYVVRGAINSAWDKLGSSGGVLGVPVGDETYNGEVSTQKFSGGQVSWNRQTKQFSTEPPGLADQLKGLQVAIDPTAAINTAWRAAGGPGGPLGAKQGGPTPVGGDGIVQNFAGGKVFFTPATGANALESDILAKYESLGGPAGSDLGFPTTNETDGGIGPSSRIATFSAPDKPVIFWTADHGAFVVRGAMRAAWDKLRAPAGKLGAPVGDQAVDGDVISQQFTGGKISWNRAKNAFSTDPSNLAPLLSGLQISGQNQPSSSAMPAHPKKFSWHWWWLMAAVPVAVLLVLLIWVLFVWRRRRPGPEATGYGVDHGYDAAEGQWGHDDADVATEHFGAPPSGEPPAGSGAAARVSWQRQAPADGGYGFEEEDPDAVDTDSIPVVSDEMLAEADYPAAEADYTDYTDAVPEVAEPETADDAAYADADYAEVDYPDVGYREDEYPDLAVPHTPPDADAVTGGIPAAEADDEYAELAAPQAQPEERPEPQPGPEEVAEAAGGAVAAGVAGTRPRSGRHAAADEEDASENGLAGPDGRPTIHLPLEDPYQAPEGYPIKASARYGLYYTPGSDLYRDTLPELWLSSEEVAQANGFTKAD

SEQ ID NO: 4257 - protein, 399 aa, Mycobacterium paratuberculosis
MLGGSNPSRPEVVHEQRHQIPAHAFRVRTRTVPRVLPGLPRSSRRAVSRRMGEGEDRRPRGVARGRQAGLPGHGGARGVRRRGQPRFPVQHHHHRGDHPRPLQRDRLRPAQRHRRALPAGPGHRGAEAALAAEILHRRTDYGDRDDRAGHRQRPAGHQDPGGQAGRPLRAQRVKDVHHQRINSDLVIVVAQTDPDKGAQGFSLLVVERGMEGFERGRHLDKIGLDAQDTAELSFTDVHVPAENLLGQEGMGFIYLMQNLPQERISIAVMAAAAMEQVLEQTLEYTKERKAFGKSIGSFQNSRFVLAELATEATVVRMMVDEFVRLHLDHKLTAEQAAMAKWYSTEKQVHLIDRCLQLHGGYGYMREYPVARAYLDARVQTIYGGTTEIMKEIIGRSLGV

SEQ ID NO: 4258 - protein, 482 aa, Mycobacterium paratuberculosis
VHHLLLPMTHPEFRDDAPAITEPSTGELALEDRSALRRVAGLSTELTDISEVEYRQLRLERVVLVGVWTDGTAADSRASMAELAALAETAGSQVLEGLIQRRDKPDPSTYIGSGKAAELRDVVLATGADTVICDGELSPAQLTALEKAVKVKVIDRTALILDIFAQHATSREGKAQVSLAQMEYMLPRLRGWGESMSRQAGGRAGGSGGGVGLRGPGETKIETDRRRIRERMAKLRREIKDMKQVRDTQRSRRLHSDVPSIAIVGYTNAGKSSLLNALTGAGVLVQDALFATLEPTTRRAEWDDGRAFVLTDTVGFVRHLPTQLVEAFRSTLEEVVDADLLVHVVDGSDVNPLAQIDAVHQVISEVIADHHGDPPPELLAVNKTDAAGDVALAKLRHALPGAVFVSAATGDGIDGLRRRIAELAVPAEAAVDVVIPYHRGDLVARLHADGRVQQEEHNAEGTRIKARVPLALAGRLREFAAP

SEQ ID NO: 4259 - protein, 220 aa, Mycobacterium paratuberculosis
VKFAKGHGTENDFVLLCDPPAELRLTGAGVAALCDRRRGLGADGVLRVTAAAAAAAAGVLDRLPDGVAGDDWYMDYRNADGSVAQMCGNGVRVFAHYLRASGLETRDEFVVGSLAGPRPVTVHAADATGADVSVDMGKANTLGGGGEAFEATVGGRRFAGLAVDVGNPHLACLDPELSVDELAALDVAAPVSFDAAQFPDGVNIEVLTAPAAGVVHMRVH

SEQ ID NO: 4260 - protein, 314 aa, Mycobacterium paratuberculosis
VTAAVRPLPIIGPTGTGKSQLALDVAERLGPLGAEIVNADAMQLYRGMDIGTAKLPVDARRGIPHHQLDVLDVTQTATVARYQRAAAADIEAILAAGAVPIIVGGSMLYIQSLLDDWSFPATDPRVRARWERRLGEVGVGELHAELARRDPAAAAAILPTDARRTVRALEVIELTGRPFAASAPRIGAPRWDTVIIGLDCDTTLLDERLARRTDAMFEQGLVAEVTGLLGRGLRDGVTAARALGYAQVIAALDAGGGDEQLRQAREQTYAGTRRYVRRQRSWFRRDHRVRWLDAGACSPPRLADAALEAWRHVS

SEQ ID NO: 4261 - protein, 173 aa, Mycobacterium paratuberculosis
VGTFAGFGDGRAGPAVPAGRRPGRDGPGPHSPLCALLGGWLRGQVQPQAAARARIYRADHDADTAVRRGRQLRAELDALPEPVGVLVVADGANTLTPAAPGGHHPGDAAAQQALDDALAGGDIAALRRLPGQILGRVAFGVLAGLAEPGPRSAKELYRGAPYGVGYFAGAWQL

SEQ ID NO: 4262 - protein, 57 aa, Mycobacterium paratuberculosis
VLSVIAIVPSAPVLVPELAGTAADELAELSAATLAAAALLPDRWLIIGTGARRPGAG

SEQ ID NO: 4263 - protein, 328 aa, Mycobacterium paratuberculosis
MSKVDVAALIALCAALASAVGDVIRQRSAHEITDKPVGHLELFRMSLRDTRWWLGGLAAITNYSLQAAALAWGSVVLVTALQVTALLFALPLYARLAHQRIKPREWAWALILAAALAVVIIVGDPASGKQRAPLHIWVIVALVMVPVLVACVVAARRWAGSPFAPVLLAVVAGSSLALFAVLTKGVVEMSEHSLVGVLTSPEFVPWLLVALTGMIFQQSAFRAGALTASLPTMTVAKPVVAGLLGVLVLDETLNAHGPKAFVLVGAVAVVIVATIALARGEAASINRPEPGPGSAPRKARDATADVAADDDDTGPFSGRLLVADSSRW

SEQ ID NO: 4264 - protein, 468 aa, Mycobacterium paratuberculosis
VPPRAAGARDTDPRGRCERCSDERMTGDQPRDDSARPAPRPGPRPGPRPVSAGRPAAHPVVVPPPPSDPHRFGRVDDDGTVWLISAAGERVVGSWQAGDREAAFAHFGRRFDDLATEVTLMEERLASGTGDARKIKAHASELAEALPTATVLGDIDALAARLASIAEQAEAAVAAERSRREEHRAAQTARKEALAAEAEELAANSTQWKAAGDRLRAILDEWKTITGLDRRVDDALWKRYSAAREAFNRRRGAHFAELDRERSSIRQAKERLCERAEELSGSTDWTATSAEFRKLLAEWKAAGRAAREVDDALWRRFKQAQDVFFTARNAATAEKDAELRANAAAKEALLAEAEKLDTGNHDAARAALRAIAEKWDAIGKVPRERSAELERRLRAVEKKVREAGDAGWSDPQAQARAEQFQARAEQYEQQARKAAAAGRTKEAEEARANAEQWRQWAQAAVEALSRKP

SEQ ID NO: 4265 - protein, 468 aa, Mycobacterium paratuberculosis; identical to SEQ ID NO: 4264

SEQ ID NO: 4266 - protein, 517 aa, Mycobacterium paratuberculosis
MTCGFSRADRSPYHGPVTSTVARDVSGVRTYQVRTYGCQMNVHDSERLAGLLEAAGYRRAAEGAEVADVVVFNTCAVRENADNKLYGNLSHLAPRKRGNPEMQIAVGGCLAQKDREAVLRRAPWVDVVFGTHNIGSLPTLLERARHNKAAQVEIAEALQQFPSSLPSARESAYAAWVSISVGCNNSCTFCIVPSLRGKEVDRSPDDILAEVRSLVADGVLEVTLLGQNVNAYGVSFADPALPRDRGAFARLLRACGEIDGLERVRFTSPHPAEFTDDVIEAMAQTPNVCPALHMPLQSGSDRVLRAMRRSYRAERFLGIIDRVRAAMPHAAITTDLIVGFPGETEEDFAATLDVVRRARFAAAFTFQYSKRPGTPAAELDGQIPKAVVQERYERLVELQESISLQGNQALVGQTVELLVATGEGRKDSATARMSGRARDGRLVHFAADDRVRPGDLVTTVITGAAPHHLIADAGVLSHRRTRAGDAHAAGRRPRGVGLGMPAVGPPAGPAQPVGCAS

SEQ ID NO: 4267 - protein, 177 aa, Mycobacterium paratuberculosis
MTCPMTASCPPPSTSEPSREEQARALCLRLLTARARTRAELHGRLAKRGYPDDVSTAVLDRLAAVGLIDDADFAQQWVQSRRAHAGKSKRALAAELHTKGVDNDVITSVLAGIDAGAERDRAEQLVRSKLRRETLAEDDARVTRRLVGMLARRGYSQNLACEVVLAELAAERERRRV

SEQ ID NO: 4268 - protein, 409 aa, Mycobacterium paratuberculosis
MSAGLSRLLRRPRRVELESNTCSATVGDVRSVNLSVAFSSVTANRPIPVRRHTDYRRGTMTQAPDREKALELAMAQIEKSYGKGSVMRLGDEMRQPISVIPTGSIALDVALGIGGLPRGRVVEIYGPESSGKTTVALHAVANAQAAGGVAAFIDAEHALDPEYAKKLGVDTDSLLVSQPDTGEQALEIADMLIRSGALDILVIDSVAALVPRAELEGEMGDSHVGLQARLMSQALRKMTGALNNSGTTAIFINQLREKIGVMFGSPETTTGGKALKFYASVRMDVRRIETLKDGTNAVGNRTRVKIVKNKVSPPFKQAEFDILYGRGISREGSLIDMGVDQGFIRKSGSWFTYEGEQLGQGKENARTFLMENDEVANEIEKKIKEKLGIGAVVTDDLSDDGVLPAPVDF

SEQ ID NO: 4269 - protein, 218 aa, Mycobacterium paratuberculosis
LDISPQLSEVSSYGGFFALTVGGDPAGWRPVTECYADGSADLIAATARRYRTRDLRIGASLVHLAHASRLWSPVLGCAIGHGVVPDLGDLHRAATGAQLRLPEPVGRRVTAPHPELLYRLVVDEHLGPLAAGLRVGLAPALLAGNVASALVGAARALLSARPDLRSAIVETTLALLDTGIMSGAGTVTGPPLDFRRASCCLFYRLPGGSVCGDCVLDR

SEQ ID NO: 4270 - protein, 68 aa, Mycobacterium paratuberculosis
MLAGMRLTEFHERVVLRFGTTYGSSVLVDHVLTGLGGRTAAQAIEDGVDPRDVWRALCVDFDVPREQW

SEQ ID NO: 4271 - protein, 386 aa, Mycobacterium paratuberculosis
MRVAVVAGPDPGHSFPAIALCRRFADAGDTPTLFTGAEWLDTARGAGVDAVELDGLAATDEDVDAGARIHRRAARMAVLNVPALRDMAPDLVVSDVITAGGGMAAELLGIPWIELSPHPLYLPSKGLPPIGSGLAPGTGLRGRLRDATMRALTARSWRAGLRQRAAARAEIGLPARDPGPLRRLIATLPALEVPRPDWPDEAVLVGPLHFEPTDRVLDIPAGSGPVVVVAPSTALTGARGLAEVALSCLTPGETLPAGARLAVSRLAGPALAAPPWAVVGLGSQAELLRHADVVVCGGGHGMVAKTLLAGVPLVAVPGGGDQWEIANRVVRQGSARLIRPLSADALVVAVNEVLSSPGYRAAAQRAAAGIADVADPVRVCREALAG

SEQ ID NO: 4272 - protein, 143 aa, Mycobacterium paratuberculosis
MTELTGTTVANTRTVEGFLNALQDADYDAAEAALADDLVYENVGLPTIHGRARAMKLFRRMEDRAAFEVKIHRIAADGGAVLTERTDALIFGPLRLQFWVCGVFEVQNGRITLWRDYFDFFDMLKATARGVAALLLPSLKATF

SEQ ID NO: 4273 - protein, 141 aa, Mycobacterium paratuberculosis
VDVGVALPGDLVDQLGVQIVHGQHVPAPHLVERVRKVHERNENRQRHAQVNVERRRDQPERGQHQHRRHRHPPHHPGRRALAGQVVAHPVAHRVRQPPAAAIADELNEIGPGAAPVLAHGALRTWLSATAAAARPPRAPWP

SEQ ID NO: 4274 - protein, 269 aa, Mycobacterium paratuberculosis
MAVNATQPGPWRALLQRGVAAAADLSDLVARKISAATDPRARLLRRRRRALRWGLIFTAGCAFWAVLTIVLAAWGWFALLLEITGAVAVVMAIPATLLLLRYRWLRAEPLPAPRTTNVRRLPPPGSAARPAMYALGASERGFASLLAVLERGAMLPAAEICDLTAAAGRTSAAMASTAAQVVSMERAAQAGEESRSYLAPTINAFTAQLSAGVRQYNEMVTAAARLVSAANGDGSTASQHYRAELVGATDRLNGWAQAFDELGGLRGAG

SEQ ID NO: 4275 - protein, 275 aa, Mycobacterium paratuberculosis
MANPFVKAWKYLMAKFNATIDERADPKVQIQQAIEEAQRTHQALTQQAAQVIGNQRQLEMRLNRQLADVEKLQVNVRQALTLADQATAAGDTAKATEYNNAAEAFAAQLVTAEQSVEDLKTLHDQALNAAAQAKKAVEQNAMVLQQKIAERTKLLSQLEQAKMQEQVSASLQSMSELAAPGNVPSLDEVRDKIERRYANAIGAAELAQGSVQGRMLEVEQAGVQMAGHSRLEQIRASMRDEALPTGGTPAAGGTQAAPAPGQGAGDAVSEKPLGQ

SEQ ID NO: 4276 - protein, 108 aa, Mycobacterium paratuberculosis
MPPLVREVIGDVLREARTTQGRTLREVSDTARVSLGYLSEVERGRKEPSSELLNAICDALDVPLSSVLTDAGERMASEERAAVAAPAGPSIDASTKVVIPPVASLALA

SEQ ID NO: 4277 - protein, 199 aa, Mycobacterium paratuberculosis
VPGQPQTGPMVGRANIANLANTLTLLRLVLVPVFLLALFAGDGHETGFRILAFLIFAFACITDRLDGLLARNYGMATEFGAFVDPIADKTLVGSALIGLSMLGELPWWITVLILAREFGVTVLRLAVIRRGVIPASWGGKLKTVVQVFAIGLFVLPWAGTPGPFRVGAAVVMGAAIVLTVITGIDYVVSTVREVRRTAA

SEQ ID NO: 4278 - protein, 174 aa, Mycobacterium paratuberculosis
VTESPQRYRPLVRRARTSDVPAIKELVDTYAGKILLEKNLVTLYEAVQEFWVAELPDSPGRVVGCGALHVLWSDLGEIRTVAVNPAMTGHGIGHAIVDRLLQVARELELKRLFVLTFETEFFGKHGFTEIEGTPVTAEVFEEMCRSYDIGVAEFLDLSYVKPNILGNSRMLLVL

SEQ ID NO: 4279 - protein, 895 aa, Mycobacterium paratuberculosis
LWPPGRSGGGVTSTTSRTGCHPTHANSGPIPQLPQSLVVTSVAGGVDDAVATTLAVMPSKTAARSGNRTSRSKATSRSNGSRGARPAAPRRKPGRPTRRRQHPPLVAAGLTCGRALRAGWMLAARGTGGAARSIGRARDIDPGHRRDGIALLLLGFSVVVAASSWFHAAGPVGAWVDTALRTFIGAGVLALPVVTAAVAVTLMRTEPDPDVRPRLILGAGLIALSVLGLRHLWSGSPGDPDARRRAAGFIGFAIGGPLSDGLTPWIAAPLLFIGFMFGLLLLTGTTIRELPVVMRNLFHTRFVEDYTDEDYTDEDYTDGDYGDEPYDYAGEFDDAAAQPEPEPAAWAPDDDAQAALQDDIPTVPEPAVKTGRGRKRGRAADNSDTIELDRVVEGPYVLPSLSLLVAGDPPKKRSAANNVMADAITEVLNQFKVDAAVTGCTRGPTVTRYEVELGPGVKVEKITALQKNIAYAVATESVRMLAPIPGKSAVGIEVPNTDREMVRLADVLTAPSTRRDHHPLVIGLGKDIEGDFISANLAKMPHLLVAGSTGSGKSSFVNSMLISLLARATPEEVRMILIDPKMVELTPYEGIPHLITPIITQPKKAAAALAWLVEEMEQRYQDMQASRVRHIDDFNAKVRSGEITAPLGSQREYRPYPYVVAIVDELADLMMTAPRDVEDAIVRITQKARAAGIHLVLATQRPSVDVVTGLIKTNVPSRLAFATSSLTDSRVILDQAGAEKLIGMGDGLFLPMGASKPIRLQGAFITDEEIQAVVAACKDQAEPEYTEGVTAVKTSSERADVDPDIGDDMDVFLQAVELVVSSQFGSTSMLQRKLRVGFAKAGRLMDLMETRGIVGPSEGSKAREVLVKPDELAGTLALIRGSGAGSADADGGDPD

SEQ ID NO: 4280 - protein, 104 aa, Mycobacterium paratuberculosis
MPVVVVATMTVKPESVDTVRDILTRAVEEVHDEPGCQLYSLHQSGETFVFVEQWADEEALKAHSTAPAIGKMFSAAGEHLDGAPDIKMLQPVPAGDPGKGQLRP

SEQ ID NO: 4281 - protein, 276 aa, Mycobacterium paratuberculosis
MPRSSEGPLTGKVAFITGAARGQGRAHAVRLAADGADIIAVDLCDQIASVPYPLATPEELAATVKLVEDIGSRIVARQADVRDRESLSAALQAGLDELGRLDIVVANAGIAPMSAGDDGWHDVIDVNLTGVYHTIKVAIPTLVKQGTGGSIVLISSSAGLAGVGSADPGSVGYVAAKHGVVGLMRVYANLLAGQMIRVNSIHPSGVETPMINNEFTREWLAKMAAATDTPGAMGNAMPVEVLAPEDVANAVAWLVSDQARYITGVTLPVDAGFLNK

SEQ ID NO: 4282 - protein, 290 aa, Mycobacterium paratuberculosis
MARNPVAQTAFGPMVLAAVEQNEPPGRRLVDDDFAELFLPAPLRWLVGATRFAPVRHLMIRGSEFTGPGLWANLACRKRFIADKLKESLDDINAVVILGAGLDTRAYLLTRRVRIPVFEVDLPVNVARKFKTVRRVLGELPLSVRLVALDLEHDDLLTALAEHGYRTDYRVFFICEGVTQYLSEATVRRTLDGLRAAAPGSRLVFTYVRSDFIDGTNRYGTRTLYRNVRQRRQLWHFGLQPGEVADFLAEYGWRLVEHAGPDELMQRYVVPTGRKLKASQLEWSAYAEKT

SEQ ID NO: 4283 - protein, 558 aa, Mycobacterium paratuberculosis
VDVDLAPPGPLAAGGLRVTALGGISEIGRNMTVFEHLGRLLIIDCGVMFPTHDEPGVDLILPDLRHIEDRLDDIEALVLTHAHEDHIGGIPYLLKLRPDIPVVGSKFTLALVAAKCREHRLKPVFVEVSEGHKSTHGVFECEYFAVNHSIPDALAIAVHTGAGTVLHTGDIKLDQLPLDGRPTDLPGMSRLGDAGVDLFLCDSTNAELPGVGPSESEVGPTLHRLIRGAEGRVIVACFASNVDRVQQIIDAAVALGRRVSFVGRSMVRNMGIARELGFLRVADADVIDIGAAELMPPERVVLITTGTQGEPMSALSRMSRGEHRSITLTAGDLVVLASSLIPGNEEAVYGVIDELAKIGARVVTNAQARVHVSGHAYAGELLFLYNGVRPRHVMPVHGTWRMLRANSKLAARTGVPEESILLAENGVSVDLVAGRASISGAVPVGKMFVDGLVDGDVGDITLGERLILSSGFVAVTVVVQRGTGRPVAPPHLHSRGFSEDPKALEPAVRRVEEELEALVAENITDPSRIAQGVRRTVGKWVGETYRRQPMIVPTVIEV

SEQ ID NO: 4284 - protein, 309 aa, Mycobacterium paratuberculosis
LPPPGNLNSVSTVGFDAPARLGTVLTAMVTPFAADGSLDTAAAARLANHLVDSGCDGLVVSGTTGESPTTTDDEKRELLRVVLEAVGDRARVIAGAGTYDTAHSVRLAKACAAEGAHGLLVVTPYYSKPPQRGLIAHFTAVADATELPVLLYDIPGRSVVPIESSTIRALASHPNIVGVKDAKADLHAGGQIIAETGLAYYSGDDALNLPWLAMGATGFISVISHVAANQLRELLSAFTSGDIATARKINATVTPLCDAMARLGGVTMSKAGLRLQGIDVGDPRLPQVPATPEQIEALTADMRAASVLR

SEQ ID NO: 4285 - protein, 250 aa, Mycobacterium paratuberculosis
VAEIAPLRVQLIAKTDFLAPPDVPWSTDADGGPALVEFAGRACYQSWSKPNPKTATNAGYIKHIIDVGHFSVLEHASVSFYITGISRSCTHELIRHRHFSYSQLSQRYVPENDSRVVVPPGLDDDPELQQILAAAADASRATYTELLARLEAKFADQPSAVLRRKQARQAARAVLPNATETRIVVTGNYRAWRHFIAMRASEHADVEIRRLAIECLRRLADVAPAVFADFEIATLADGTEVATSPLATEA

SEQ ID NO: 4286 - protein, 412 aa, Mycobacterium paratuberculosis
VSPGGGIVGAVSTRRLSVAQARRIAVAAQGFTEPRPAGAVTRAHLNRLISKIQVLQLDSVSVTVRAHYAPVFSRLGPYDREVLDRAAWGPRSSRLLVEYWAHEAALMAVEDWPLLRWRMRQYRHGRWGTHIVQANPRLADAVVAAVAELGPSTAGQIEAHLAAEPRRRKGAWWNRSDTKWVAEALFAAGVLTTATRVGFARHYDLVERVLPADVLARRVDDDEAIRELTLRAAGALGVGTEADIRDYFRLSAAQVKPAIAELVAAGDLERVEVAGWPAPAYLRAGRAVPRTDRGTALLCPFDPLIFFRPRVERLFEFHYRIEIYTPAAKRRYGYYVWPLLMDGRLAARVDLKADRAEGTLRVLGAFAEPQAPRPRVAAVLAGELWSMASWLGLGGLSVADRGDLALALRAVA

SEQ ID NO: 4287 - protein, 267 aa, Mycobacterium paratuberculosis
HTRTRGSVTHRLPAAVREKGELAVITEPVKTFSRKFMGYDTTAVDAHIEMLTAKQQLLIDDVESLRARLQESNEQTAALRKEVAALTDTSPAPHAVQQRMAKMLARAVDEVAEMQAEARAEADALIAAAEAEAQAAERKRDEVLADMAAQQEALEAEYRETKEKLDAELADMRAEAQAAIDEARRAAERECEQLLGDAKQGADHYRDTARRAVEEASAQRIKILEQLMSVYRELEDVPAALQAAYDEQQGSADDGVLAAMDGKVRAG

SEQ ID NO: 4288 - protein, 181 aa, Mycobacterium paratuberculosis
MTRAEVGLVWAQSTSGVIGRGGDIPWSVPEDLTRFKEVTMGHTVIMGRRTWESLPAKVRPLPGRRNVVVSRRPDFVAEGARVAGSLEAALAHAGSDPAPWVIGGAQIYLLALPHATRCEVTEIEIDLRRDDDDALAPALDDSWVGETGEWLASRSGLRYRFHSYRRDPRSSVRGCSPSRPS

SEQ ID NO: 4289 - protein, 266 aa, Mycobacterium paratuberculosis
VPIPTPYEDLLRLVLDRGTAKSDRTGTGTRSLFGQQLRYDLSAGFPLITTKKVHLKSVVYELLWFLRGDSNVDWLHRHGVTIWDEWASDTGDLGPIYGVQWRSWPTPSGEHIDQISAALDLLRTDPDSRRIIVSAWNVGEIPRMALPPCHAFFQFYVADGRLSCQLYQRSADLFLGVPFNIASYALLTHMMAAQAGLSVGEFVWTGGDCHIYDNHVEQVRLQLSREPRPYPELILAHRDSIFDYTYDDVVVHNYDPHPAIKAPVAV

SEQ ID NO: 4290 - protein, 246 aa, Mycobacterium paratuberculosis
MPKITDSISTADGTCPVRLFFPDGSGPWPGVVMYPDAGGVRDTFDQMAAELAGFGYAVLLPDVYYRSGEWAPFDMATVFADQQERNRLFAMIGSVTPDRMATDAAAFFDYLAARPEVSGDRFGVCGYCMGGRTSLIVAGRLPDRVAAAASFHGGGLVTDSDDSPHLLADRMSATVHVGGAQDDASFTTDHAEQLDKALTAAGVRHTIEWYSAAHGFAVPDNAPYDPAAAERHWDAMRDVFAAALPR

SEQ ID NO: 4291 - protein, 405 aa, Mycobacterium paratuberculosis
MRVLLSAYDSRGGVQPLAALAVQLRALGVDARVSAPPDAEFAELLARAGVPLVAFGDSLRAMKTAATTPSEEQLRRQLDGLIAAQFDAAAAARECDALVVAGFPPAAAAARSAAEKQGAHYVYVSYQPTILPSPHYPPPGYADAPSAAGLIDNRLLWQLDGRYMQALFGETLNARRAAIGLPPLDDLRGYALTERPWLATDPTLDPWRPPGDLDVVQTGAWLLADDRRLPAELEAFLDAGAPPVYVGFGSMPMRACRDVARVAIEAVRAQRRRAVVSRGWAGLGPIDDGEDCLVVGEVNHQALFGRVAAVVHHGGVGTLTAAALAGAPQVVVPQGADQPYWAARVAELGIGAAHDGPAPTVESLSAALGTALTERTRARAGAVAATIRTDGAARAARLLVARLAG

SEQ ID NO: 4292 - protein, 259 aa, Mycobacterium paratuberculosis
MTSQDLTGRTAIITGASRGIGLAIAQQLAAAGANVVLTARKQEAADEAAAQVGPQALGVGAHAVDEDAARQCVQLTLERFGSVDILVNNAGTNPAYGPLIEQDHARFAKIFDVNLWAPLLWTSLAVKSWMGEHGGSIVNTASIGGLHQSPAMGMYNATKAALIHVTKQLALELSPRVRVNAIAPGVVRTRLAEALWKDHEDPLSSSIALGRIGEPIDVAAAVAFLVSDAASWITGETLVIDGGTVLGAAQGFRPAPTPS

SEQ ID NO: 4293 - protein, 1075 aa, Mycobacterium paratuberculosis
MTASLLVANRGEIALRIIRTATELGMRTVAVYAADDAHSPHVHAADEAMPLPGSGPPAYLNQAALLAVAENTGATLIHPGYGFLSENAEFAKACAAASHTFVGPDGRVLELLGNKTAARRAAIAAGVPTLAATDGPSGVEDIEAFFAAHPGGIMIKALAGGGGRGMRKVHNAAQIAGAYQRCAAEARLGFGDPALFAEALLGDARHIEVQVVAAPAGHQTHALAVGDRDCSMQRRYQKLIEIAPAQGLSEELRRALHQAAVRLCARVGLRGLATVEFLVSGERFVFLEVNPRIQVEHTVTEQTTGLDLVAVQLAIAGGESYYRLGLPAGIASDGTEVIGEPAAQRGIAIQLRVNAETFGADFSVLPSAGTLTAFCPPSGPGVRVDTYGRPGLVVSPQYDSLLAKVIVAVHGSSWRAAMRKADTALSEFGVEGVATNIGFLRRLLAEQRLETGWVNTDFVDEKLPELAAAALTHQPGPQPGAVELYPGEDALRAQLAGTVVEVAPEGADYPAGAQLVVLEAMKMQHVLAAPDALRTVRVLVTPGQVVGTGDPLLVFTRTTGGDDGESETAATDLDLTRADLDEVIERHARTLDEGRPDAVAKRHRQGRRTARENIDDLVDPGSFVEYGALAIAAQRSRRSEEDLIANTPADGLVAGLATVGADRFGPAAAQAVVASYDYTVLAGTQGMRNHAKTDRVFDLAARKRLPVVLFAEGGGGRPGDTDVGGAAGLDVPTFRMLAGLRGRVPLVSVVSGRCFAGNAALAGVCDVIIATPDANIGMGGPAMIEGGGLGVYPPEAIGPIAVQRRNGVVGLVARDEAHAVSLAKQYLSYFQGRLDRWQAPDPRVARHVVPQNRLRAYDVHRAIEAIVDVGSVLELRPDYGVGIVTALVRVEGVPYGLIANSTHHLGGAIDAEAADKAGDFLALCESFGLPVISLCDTPGFMVGPDAETQAAVRRFGRMFVLGARLTVPLGMIILRKGYGLGAMAMAGGSFRAPQFTVAWPTGEIGGMGLESAVRLGYRKELAAVTDPAERQNLFDRLVAAAYQHGKALRAATTFELDDVIDPAASRAWITRLSGG

SEQ ID NO: 4294 - protein, 1075 aa, Mycobacterium paratuberculosis; identical to SEQ ID NO: 4293

SEQ ID NO: 4295 - protein, 280 aa, Mycobacterium paratuberculosis
VIAVTIEDPAIMPEAFFTVDGDSYVPGTMTRGPWGAAMGGQIVGGLLGWGIEQSGVDPDLQPARFTVDLLRPALLAPVQIRTSVQREGRRIKLVDAGLVQNGVVVARASALFLRRGDHPDGQVWSPPVQMPPLPTSSEGFPADMPFLIWGYGATRAGSPGIAAGEWEQAHSQKFAWARLFRPMVHGHPLTPFTRLAFVGDITSSLTHWGTGGLRYINADYTVSASRLPDGEFLGLAAQSHYGTAGVAAGAATLFDRHGPLGTSWALALAQPADAFQPAYT

SEQ ID NO: 4296 - protein, 155 aa, Mycobacterium paratuberculosis
VTDTPSKTLLIVHHTPSPHTHEMFEAVVSGATDPEIEGVEVVRRAALTVSPAEMLAADGYLLGTPANLGYISGALKHAFDCSYYQLLDSTRGRPFGLYLHGNEGTEGAQRAVDTITTGLGWTKAAETVVVSGKPSKDDLQACWELGATVAAQLMD

SEQ ID NO: 4297 - protein, 155 aa, Mycobacterium paratuberculosis; identical to SEQ ID NO: 4296

SEQ ID NO: 4298 - protein, 245 aa, Mycobacterium paratuberculosis
MRVGVLGAKGKVGSTMVAAVQAAEDLTLSAEVDAGDPLSLLTDGGTEAVIDFTHPDVVMGNLEFLVRNGIHAVVGTTGFTAERLAQVREWLADSPGTSVLVAPNFAIGAVLSMHFAKQAARFFDSAEVIELHHPHKADAPSGTATRTAKLIAEARKGLPPNPDATSTSLPGARGADVDGIPVHAVRLAGLVAHQEILFGTEGETLSIRHDSLDRTSFVPGVLLAVRRIREHPGLTVGLEPLLDLG

SEQ ID NO: 4299 - protein, 186 aa, Mycobacterium paratuberculosis
VRAGWANAAAAITVVVAACPCPTGSADSTPDSPPFPIGQLGVPVHARAASGATADITVNSATWLPPGCTSHFATPTAGSACNVVELTITATSHRFFQVNQRYMFAGYGGGNQPWTHPDDAPQPATMAVDYQRLGKMPPLQTGGLHDGQTAHGFVGFAMPAGGDLYLTINDPEQPAPYTEAGWIVHT

SEQ ID NO: 4300 - protein, 454 aa, Mycobacterium paratuberculosis
DSNMHSIEVPAEVRAALDALDAADAAIRALDFDALHPVVRLRALERMEASRRRQIAVSHGVIAGLAGEGPGNVGGPVHKVIADRLRISYAEACRRLREAKQLSPRLTLTGQELPPELPATAGVWREGMLDGQHLRVIEKFVRDLPETTPVRALEEAERFLAHQATLLRPDQLEKVAHQCALRINPDGKFSDADRARQRGFTWCGQRADGMSFGKLWASPELRANLDAWLARFAAPGMCNPDDEAPCVAGEPDEESATKDSRTPAQRQHDALNALLRGRLGDPKLGLHNGLPVTVVVSTTLRELTTGAGRAVTGGGTLLPMRDVIRMARHAYHYLAVFDEHSSRPLYLGRSRRVASPDQRVVLYAKDRGCTHPGCDAPGYWCEVHHLNEWATGGLTDVDNLTFACGPHHKLIENGWRTKKLADGRTAWIPPPQWDRGARTNDFHHPERDFDGEDP

SEQ ID NO: 4301 - protein, 360 aa, Mycobacterium paratuberculosis
MGTAPIRVFQVGSGNVGSEMIRRIATQPDLELIGVHCYSPEKIGKDTGQFAGLAPNGVKFTGTVEEIIAAKPDVLTFHGVFPDEDLYVKVLEAGIDIVTTADWITGWRRDKNHPHPSGKPVTQLLAEAAAKGGATFYGTGMNPGLNQILGVVCSADVAEIENVTTIESVDVSCHHSKDTWIEVGYGQPVDDPEIPAKLEKYTRVFADSVYMMADCFDLTLDEVTFSYELGACTKDVDLGWYTLPKGSLGGNYIKYQGMVDGVPRVETHLEWQMTPHTDPSWNVKGCYITQIKGDPCIYNKHMIFPKPGVDLSNPDNFASIGMTVTGMPALAAIRSVVAAPPGLLTSADLPLRGFAGRFKK

SEQ ID NO: 4302 - protein, 387 aa, Mycobacterium paratuberculosis
LGRRPATPAPLVCRVIRRSYPPALIRPQSFIEGTLIWRRGGLIFVPEGGQLRWEGTMAKPPLSMKPTGWFQVAWSDEIGVGDVHKMKYFDQEMVAWRAESGQLTVMNAYCEHLGAHLGYGGKVVGEVLQCPFHGWQWSAEGRNVCIPYQDRPNRGRRMRTYPVVERNASVYIWHDLQRREPYFDPPDVFAAFGDGSSADDYYPQQRLYRQALEMHPQYVLENGVDFAHFKFVHNTPIVPVFTRHDFAEPVSYVDFTITFEGDDGQKIEDVNSGVQAINGGLGIAVTKSWGMIDNRTISAITPVDERTSDVRFMVYIGRTPAKDAARAQRKAAEFGDEVIRQFTQDIEIWQHQRYSDPPALAADEYQGFMAIRQWAKQFYPEFAAQEA

SEQ ID NO: 4303 - protein, 216 aa, Mycobacterium paratuberculosis
MTRQTSGAGVAGRRPNRRGHATRESMLEAALRSLASGEPGSVSANRIAKDIGATWGAVQYQFGDTDGFWAAVLHRTAERRAATFSSLSSPVSPEAPLRERVGAIIETLYRGLAAPDSRAIENLRAALPRDPDELERLYPRTAAELFSWGKSWLETCQQAFAGLAVDPDRVREVAALIPGAMRGLVSERQLGSYADLDMARRGLTNALAAYLEQSRP

SEQ ID NO: 4304 - protein, 366 aa, Mycobacterium paratuberculosis
MSIRWAASRPPSIWASRPADLYGRRDHDRFTAVLWGVRAVFEGFASVSRWHPARVKPVQRKLTAVVTKREFAAPDVVALTLADPDGGLLPSWTPGAHIDVLLPSGRRRQYSLCGPPGHRGEYRIAVRRIADGGGGSIEMHEAFGVGDTVEFEGPRNAFYLGTAEHDVLFVIGGIGVTPILPMIRVAAQRGIDWRAIYTGRSREYMPLLDEVVSVDPQRVTVWADDEHGRFPTAAELLAAAGPATAVYVCGPSAMLEAVRIARNEHAGAPLHYERFSPAPVVDGVPFELELARSRQVLAVPANRTALDVMLDRDPTTPYSCRQGFCGTCRVKVLAGQVDHRGRTDPGQDGMLVCVSRADGGRLVIDA

SEQ ID NO: 4305 - protein, 595 aa, Mycobacterium paratuberculosis
PMTVTSTITADDGVTLAVHRYTDIDPARPTILAIHGFPDNHHVWDGVADELTGAPYNFVAYDVRGAGESSCPATRSGYGFAQLVRDMGAVIDSLGVGRVHLLAHDWGSIQAWAAVTDKAVTGESVMDKVASFTSISGPHLNYAGTFLHSARTPRAVARVVRQLIASGYIGFFLCPGAAELSFRAGIGVKVIAALERIGHTSTRSQRRDTRRSLRDYLNGLQLYRQNMPAPMLAPGPRLPETTVPVQTLVPRRDVFVTPALQRFTGAIPQRARVIEIEGGHWVVTSRPDVIARLTTEWVDLQSAGAVAPQLTGERRELPGERREVRGRLALVTGAGAGIGRATAVELARQGARKVVTVDRDRAAADQTADAVRAAGAGAAVYQVDVSDEAAMNDLAAQVRNEHGVVDILVNNAGIGMAGRFLETSPANWDAIMGVNVRGVIWGSRAFGTQMVERGQGGTIINVASAAAYLPSKSMVAYGTTKAAVLALSESLRADFADEGITVTAVCPGFVNTNIAKSTIYAGMSAQQQEWARDRADTAYRRRNFTPEATAKAIVKAIKTGPAVVPIAAESRIGYALRRISPGAIRLLARWDIRQT

SEQ ID NO: 4306 - protein, 302 aa, Mycobacterium paratuberculosis
MVTIDNQAAGPHDASVDHERLVLEARDVDFDWAQLPFHYVPGEPFATHVLNVLHLQLPAGEQFFVEVFKQALPLIRDDQLRLDVQGFIGQEGVHSRAHANVLAHFAARGIDLRPYTGQIEWLFGTLLGPRPNWSPRRRQSWLLEQISLVSAIEHYTAILGEWILDSPAHDRIGTDPVMLDMLRWHGAEEVEHKAVAFDTMKHLRAGYWRQVRTQLVVTPAMLLLWIRGVRFMYSRDPYLPPHTKPRWRDYFRAARRGLVPGPLRFVRAVANYYRPGFHPSQLGGLQRAVDYLAVSPAARASH

SEQ ID NO: 4307 - protein, 153 aa, Mycobacterium paratuberculosis
MSAPSVSASVHIDARPEVVYRLITDLPTLASLAEEAVAMQWRKGDAARPGAVFTGHNQNGGRRWSTKCTVTDAEPGRRFAFDVRHTVFPVARWQYDIVGTDGGCDVTESTWDRRPGWFAKVAGRATGVTDRAGANAEHIRLTLQRLKQRAEAE

SEQ ID NO: 4308 - protein, 373 aa, Mycobacterium paratuberculosis
MRVGVPTETKTNEFRVALTPAGVAELTRRGHEVLVQSGAGEGSSIPDSEFKAAGAQLADTAEQVWADAELLLKVKEPVPAEYDLLRRNQILFTFLHLAASRACTEALLTSGTTSIAYETVQTADGTLPLLAPMSEVAGRLSAQVGAYHLMRTHGGRGVLMGGVPGVKPADVVVVGAGTAGYNAARVAGGMGAMVTVLDVNINKLRLLDAEFGGQVRTRYSSAYDLEGTVKRADLVIGAVLLPGAKAPNLISNSLVAQMKSGAVLVDISIDQGGCFEDSRPTTHDDPTFAVHDTVFYCVANMPSAVPKTSTVALTNATMPYVLALADRGWRAACRSNHALAKGLSTHDGALLSQQVAADLGLPCTDPAGVLQQD

SEQ ID NO: 4309 - protein, 341 aa, Mycobacterium paratuberculosis
MVLGFWDITVPIVGAPMAGGPGTPALAAAVSNAGGLGFVPAGYVSAEQFADDIAAARKATTGPLGVNLFVPQPSVADWVALDYYAAELEEIAEHYQVEVGHPRYGDDDGWEQKLEVVADVRPELVSFTFGVPPPDVIRRLGALGLLVMVTVTSAYEAGVAVAAGADSLVVQGPAAGGHRGTFAPDMEPANESLHQLIDRIRHAHDIPIIAAGGLGTADEVGAALRRGAVAAQVGTALLLADEAGTNAAHRTALKNPLFATTVVTRAFSGRYARGLENDFTRMLDHVAPLGYPEVNQMTTPIVEAAAAIEDPNGIPLWAGAAFKHASAGPAADIVAGLAATG

SEQ ID NO: 4310 - protein, 440 aa, Mycobacterium paratuberculosis
LRAGKVVEAQPHPHAALRRSTLPGGLRVVTEYLPAVRSASVGVWVGVGSRDEGATVAGAAHFLEHLLFKSTPTRTAVDIAQAMDAVGGELNAFTAKEHTCYYAHVLDADLELAVDLVADVVLNGRCAAEDVELERDVVLEEIAMRDDDPEDALGDMFLGALFGDHPVGRPVIGTARSVASMTRTQLHSFHVRRYTPERMVVAVAGNVDHDEVVAMVREHFGPHLVRGRQPIAPRKGAGRVNGRPGLLLGTRDAEQTHVSLGVRTPGRGWQHRWALSVLHTALGGGLSSRLFQEIRELRGLAYSVYSTVDIFADSGALSVYAACQPERFAEVMAVTSGVLESVARDGITESECRIAKGSLRGGLVLGLEDSGSRMSRLGRNELNYGRHRSIEHTLAQIDRVSVDEVNAIARRLLTQHYGAAVLGPYGTKRSLPQQLRAMVR

SEQ ID NO: 4311 - protein, 757 aa, Mycobacterium paratuberculosis
MSVAEIEEGVFEATATIDNGSFGTRTIRFETGRLAQQAAGAVVAYLDDENMLLSATTASKSPKEHFDFFPLTVDVEERMYAAGRIPGSFFRREGRPSTDAILTCRLIDRPLRPSFVDGLRNEIQVVVTILSLDPNDLYDVLAINAASASTQLGGLPFSGPIGGVRVALIDGTWVAFPTVEQLERAVFDMVVAGRKVDGADGPDVAIMMVEAEATSNVIELIDGGAQAPTETVVAQGLEAAKPFIEVLCTAQQELADKAARPTSDYPTFPDYGDDVYYSVASVATDELSKALTIGGKAERDARTDELKAEVLARLAETYEGREKEVSAAFRSLTKKLVRQRILTDHFRIDGRGITDIRALSAEVAVVPRAHGSALFQRGETQILGVTTLDMVKMAQQIDSLGPETTKRYMHHYNFPPFSTGETGRVGSPKRREIGHGALAERALVPVLPSLEDFPYAIRQVSEALGSNGSTSMGSVCASTLALLNAGVPLKAPVAGIAMGLVSDDIEVEAGDGTKSLERRFVTLTDILGAEDAFGDMDFKVAGTKDFVTALQLDTKLDGIPSQVLAGALSQAKDARLTILEVMAEAIDEPDEMSPYAPRVTTIRVPVDKIGEVIGPKGKIINAITEETGAQISIEDDGTVFVGATDGPSAQAAIDRINAIANPQLPTVGERFLGTVVKTTDFGAFVSLLPGRDGLVHISKLGKGKRIAKVEDVVNVGDKLRVEIADIDKRGKISLVLVEEDNSAPADTPAAAPADATS

SEQ ID NO: 4312 - protein, 89 aa, Mycobacterium paratuberculosis
VALTAEQKKEILGTYGLHDTDTGSPEAQVALLTKRIADLTEHLKVHKHDHHSRRGLLLLVGRRRRLLKYVAQIDVERYRSLVERLGLRR

SEQ ID NO: 4313 - protein, 327 aa, Mycobacterium paratuberculosis
LAGVQRWRGQDEIPTDWGRCVLTIGVFDGVHRGHAELIAHAVKAGRARNVPTVLMTFDPHPMEVVYPGSHPAQLTTLTRRAELVEELGIDVFLVMPFTTDFMKLTPDRYVHELLVENLHVVEVVVGENFTFGKKATGNVETLRRAGERFGFAVEAMSLLSEHHSNQTVTFSSTYIRSCVDAGDVVAAMEALGRPHRVEGVVVRGEGRGIQLGFPTANVAPPMYSAIPADGVYAAWFTVLGHGPVTGTVIPGERYQAAVSVGTNPTFSGRTRTVEAFVLDTQADLYGQHVALDFVARIRGQHKFDSVDDLVVAMGQDTERARQLLSAG

SEQ ID NO: 4314 - protein, 83 aa, Mycobacterium paratuberculosis
VRADEERGGLTAVGQDYLKAIWNAQEWSPEGAPQKVSTKMLAEKIGVSASTASESIRKLAEQGLVDHEKYGAVTLTEAGRRGA

SEQ ID NO: 4315 - protein, 149 aa, Mycobacterium paratuberculosis
MVRRHRLLETFLVNELGYAWDEVHDEAEVLEHAVSDRLVARIDAKLGFPQRDPHGDPIPATDGQVPTPPARQLWACGDGDTGTVARISDADSEMLRYFTDVGINLDSRLRVLTRREFAGMISVAIESGDGAETTVDLGSPAARAIWVTA

SEQ ID NO: 4316 - protein, 418 aa, Mycobacterium paratuberculosis
MIEWSDTDLMVRDAVRQFVDKEIRPHLDELESGAMSPYPIARKLFSQFGLDTMAAEAVKKVLDRERSGVDENGDSSGAANEFSGGGAQGSMIAVLVSEIARVSIGLLSTASVSLGLGAATIASRGTLAQKERWLPELMTLEKIAAWAITEPDSGSDAFGGMKTSVRRSGDGDGAYILNGQKTFITNGPYADVLVVYAKLDEGDPSVDKRNRPVLVFVLDAGMPGLTQGKPFKKMGMMSSPTGELFFDNVRLTPDRLLGESEQHTEGDGRDSARANFAAERIGIAMMALGIIDECHRLCVDYANSRTLWGKNIGQFQLIQLKLAKMEIARMNVQNMVFHTIERQRAGKPLTLAEASAIKLYSSEAATEVAMEAVQLFGGNGYMAEYRVEQLARDAKSLMIYAGSNEVQVTHIAKGLLSS

SEQ ID NO: 4317 - protein, 396 aa, Mycobacterium paratuberculosis
MSNKVYVVGVGMTKFEKPGRREGWDYPDMARESGTNALADAGIDYREVQQGYVGYVAGDSTSGQRALYELGMTGIPIVNVNNNCSTGSTALFLAAQAIRGGLVDCAIALGFEKMQPGSLGGGAQDRESPMGRHVKAMAEIDEFAMPVAPWMFGAAGREHMRQYGSTAEHFAKIGYKNHKHSVNNPFAQFQESYTLEDILAARMISDPLTKLQCSPTSDGSGAAILASEAFVDKHGLAGQAVEIVGQAMTTDFASTFDGSAKNLIGYDMNVQAAQQVYNQCGLGPQDFQVIELHDCFSANELLLYEALGLCGPGEAPKLIDNGDTTYGGRWVVNPSGGLISKGHPLGATGLAQCAELTWQLRGTADKRQVENVSAALQHNIGLGGAAVVTAYQRAER

SEQ ID NO: 4318 - protein, 293 aa, Mycobacterium paratuberculosis
MSPPGLVVVDKPAGMTSHDVVGRCRRIFATRRVGHAGTLDPMATGVLVLGVERATKILGLLTAAAKSYSATIRLGQATSTDDAEGDVARSVDARHLTSQAIEAAVGGLRGDIHQVPSTVSAIKVAGKRAYKLVREGQAVELPARPVRIDRFEVRGLRAAGACVDVDVEVDCSSGTYVRALARDLGAALGVGGHLTALRRTRVGRFGLEQAYGLDELAECPRLSYSLDEACLLIFGRRDLSADEAEAAGNGRALAAAGIDGVYAACAPDGRVIALLRDEGARTKSVVVLRPATL

SEQ ID NO: 4319 - protein, 225 aa, Mycobacterium paratuberculosis
MTGTLVSSVLPASDALAYSEVYSDPPGLAPLPEEEPLIARSVAKRRNEFITVRHCARIALGELGLPPAPILKGEKGEPRWPDGVVGSLTHCTGYRGAVVGRTGAVRSVGIDAEPHDVLPDGVLNAISLPAERSEIPSALPGDLHWDRILFCAKEATYKAWFPLTRRWLGFEDARITFEADHPGATTGGFVSRILIDPAALCGPPLTALSGRWSVARGLVLTAIVL

SEQ ID NO: 4320 - protein, 329 aa, Mycobacterium paratuberculosis
VESLGWGVVAGQESSNAGQPTLWAVSDLHTGHLGNKPVTESLHPSSPEDWLIVAGDVAERTDDIRWALDLLRRRFAKVIWVPGNHELWTTTRDPVQIFGKARYDYLVNMCDEMGVITPEHPFPVWTERGGPATIVPMFLLYDYSFLPDGAASKAEGLMIARDRNVVATDEFLLSPEPYPTREAWCRERLEITRARLEALDWMTPTVLVNHFPLVREPCDALFYPEFSLWCGTTKTADWHTRYNAVCSVYGHLHIPRTTWYDDVRFEEVSVGYPREWRRRKPYGWLRQVLPDPQYAPGYLNDFGGHFEITPEMRRQATQFRERLRQRQSR

SEQ ID NO: 4321 - protein, 181 aa, Mycobacterium paratuberculosis
VTPRTRLVHSRQGTAEASGGVVFANVRLLGALGALLAAAIAGTAGVLSAPPAPDGGAAGPVELRSTAQPLETTMKSPIVATTDPRPFDPCEDIPFDAVQGLGLAFTPPEHEDGLRCHFDAGNYQVAVEPIIWRTYEQSLPADAVETTIAGHRAAQYWVLKPTYHNSYWFYSCMVAFKTSYG

SEQ ID NO: 4322 - protein, 575 aa, Mycobacterium paratuberculosis
VSLTSLRPAQPALHTLRHLGGRAAGRLLGLPPATTDYTVRRVAVPMRDGVELVADHYAPATSAPAGTLLVRAPYGRGFPFALVFGGLYAARGYHVVLQSVRGTFGSGGVFEPMAHEVADGADTVAWLREQPWFTGRFATIGMSYLGFTQWALLQDPPPDMATAVIMVGPHDFNESTWGTGSFAVNDFLGWSDMVSHQEDPVRARAALHQLRARRKVAEAAAGVPLGEAARALLGTGAPWFESWIEHADPSDPFWNSLRCNEALDRVRVPVLLVGGWQDLFIRQTLQQYAHLRARGVDVALTVGPWTHTQLLTSGLGVCTRESLQWLDTHLGDAPGRRAGRVHVYVTGVDRSRAWRRLPDWPPATTERALYLRPGGYLGETAPSLKGLAPATFRYDPAHPTPTTGGPLLSPNGGYRDDTRLASRDDVLAFTSATLTEDVYVYGNPVVELAHGADHPHADLFVRVSEVDAAGRSRNVTETYRRLSAAAKPQADKVIRLELDGTAHRFRAGSRIRLLIAGSWSPRYAHNLGSGEPVLTARRLTPVTHSVRYGRSRLLLPVGPAEPSADGVADPVGDGG

SEQ ID NO: 4323 - protein, 186 aa, Mycobacterium paratuberculosis
MMLATTTLALKEWSAAVHALLDGRQRVLLRKGGIGEKRFELAAGEFLLFPTVAHSHAQRVRPEHQDLLAPAAADSTDDELVIRAAAKVVAAVPVNRPDGLPAIEDLHIWTAESVRADRLDFRPKHKLAVLVVSVTPLAEPVRLARTPDYAGCKSWVQLPVHARLGPPIHDDETLAAVADRVRDAVG

SEQ ID NO: 4324 - protein, 249 aa, Mycobacterium paratuberculosis
MTDEILLSNTEERVRTLTLNRPQARNALSAALRDRFFGALADAETDDDVDVVIITGADPVFCAGLDLKELGGSSALPDISPRWPALTKPVIGAINGAAVTGGLELALYCDILIASENARFADTHARVGLLPTWGLSVRLPQKVGIGLARRMSLTGDYLSAADALRAGLVTEVVPHDQLLGAAQAVAASIVGNNQNAVRALLASYHRIDDAQTSAGLWQEAMAARQFRTSGDDIAANREAVLARGRSQVR

SEQ ID NO: 4325 - protein, 331 aa, Mycobacterium paratuberculosis
VTTTNPNTELTGVRVDAHGAVELLSRAGTVAVIAHVHPDADTIGAGLALGLVLDKCGKRVEVSFAEPAGLPESLASLPGCRLLVRPDEIRRDADLVVTVDVPSVKRLGVLSELAVTGREVLVIDHHASNDVFGTANFIDVAADSTTMMIADILDAWGKPIDPDVAHCIYAGLTTDTGSFRWASARALRLAARLVDIGVDNAGISRALMDTHPFGWLPLLSRVLASAQLLPDAVGGRGLVYAVVGNQDWISSRPEEVESIVDIVRTTQQAEVAAVFKEIAPGQWSVSMRAKAQVDLAAVASGFGGGGHRLAAGYSTTGSIEDAVASLRAALG

SEQ ID NO: 4326 - protein, 162 aa, Mycobacterium paratuberculosis
MPDPARARRLAKRINTIVASAIEFEIKDPGLDGVTIVDTKVTADLHDATVFYTVMGRTLDDEPDYGAAAAALERAKGALRTMVGAGTGVRFTPTLTFTRDTTSDSVARMDELLARARAADADLARVRSGAKPAGEADPYRESGSGVEPGRDGSIGDDDQPEY

SEQ ID NO: 4327 - protein, 925 aa, Mycobacterium paratuberculosis
VAGKARVHELAKELGVTSKEVLARLNEQGEFVKSASSTVEAPVARRLRESFGGGKAAEGAAKAPAKAAAKGDAKTAAKGDVKAPDKALDAALDNAIKAGGNGEAAAPPAQPGGTATTPAAQATPEAPARPGPAAARPSAPAPGQPKPPAPGQPPRPGATPGPRPGPAPKPAARTPRVGNNPFSSAQPVDRPIPRPVPRPGAPRPGAPRPGASPGNMPPRPGGVGGPGRPARPGAPRPGGGRPGGPGGRDGGGGNYRGGGVGASPGGGGGFRGRPGGGGGGRPGQRGGAAGAFGRPGGAPRRGRKSKRQKRQEYDSMQAPVVGGVRLPHGNGETIRLARGASLSDFAEKIDANPASLVQALFNLGEMVTATQSVGDETLELLGSEMNYNVQVVSPEDEDRELLESFDLTYGEDEGTEEDLQTRPPVVTVMGHVDHGKTRLLDTIRKANVREAEAGGITQHIGAYQVTVEHDGVERPITFIDTPGHEAFTAMRARGAKATDIAILVVAADDGVMPQTVEAINHAQAADVPIVVAVNKIDVEGADPQKIRGQLTEYGLVPEEFGGDTMFVDISAKQGTNIDQLLEAVLLTADAALDLRANPDMEAQGVAIEAHLDRGRGPVATVLIQRGTLRVGDSIVAGDAYGRVRRMVDEHGDDVEEALPSRPVQVIGFTSVPGAGDNLLVVDEDRIARQIADKRSARKRNALAARSRKRISLEDLDSALKETSQLNLILKGDNAGTVEALEEALMGIQIDDEVALRVIDRGVGGITETNVNLASASDAVIIGFNVRAEGKATELANREGVEIRYYSVIYQAIDEIEKALRGMLKPIYEENQLGRAEIRAIFRSSKVGIIAGCMITSGVVRRNAKARLLRDNVVVSENLTINSLRREKDDVTEVREGFECGMTLGYSDIKEGDVIESYELVQKERT

SEQ ID NO: 4328 - protein, 102 aa, Mycobacterium paratuberculosis
VRTCVGCRKRELAVELLRVVAVPTGNGEFAAIVDTAGNLPGRGAWLHPAPQCAQQAIRRRAFTKALRITGSPDTSAVVEHIESLHAPERPATEQVAKNMSTP

SEQ ID NO: 4329 - protein, 351 aa, Mycobacterium paratuberculosis
MNIDMAALHAIEVDRGISVNELLETIKSALLTAYRHTEGHQNDARIEIDRKTGVVKVIARETDEDGNVISEWDDTPEGFGRIAATTARQVMLQRFRDAENERTYGEFSTREGEIVAGVIQRDSRANARGLVVVRMGTETKASEGVIPAAEQVPGESYEHGNRVRCYVIGVTRGAREPLITLSRTHPNLVRKLFSLEVPEIADGSVEIVAVAREAGHRSKIAVKSNLPGLNAKGACIGPMGQRVRNVMSELSGEKIDIIDYDDDPARFVANALSPAKVVSVSIIDQAARAARVVVPDFQLSLAIGKEGQNARLAARLTGWRIDIRGDSPGGAGGHSESRPEHGATHGMAHDR

SEQ ID NO: 4330 - protein, 175 aa, Mycobacterium paratuberculosis
VTTGLPSQTQVIELLGGEFARAGYEIEDVVIDAHARPPRITVIADGDDGLDLDAAATLSRSASALLDKLDTIEDHYVLEVSSPGVDRPLRTPKHFRRARGRKVDVVLSDNSTVTGRVGETGDDTIALVVRAGRDWAIREIPLGDVVKAVVQVEFSPPAQAELELAGVGGTDKTEE

SEQ ID NO: 4331 - protein, 179 aa, Mycobacterium paratuberculosis
VPSAVPPVNRRVNRREVLAGGAALAALGAVSACSKPAPKPPPVEQLLGPLDQARHDSALAGAAAAALGNPPQVAAALTVVASQRAAHARALSTEISRAAGKLATSSTSETTSPSPAQPAGPPPPPPPVSDVINALRASADSASRLVGTESGYRAGLLASIAASCTASYTVALVPGGPSI

SEQ ID NO: 4332 - protein, 164 aa, Mycobacterium paratuberculosis
LHGVLHRRAGARGAVDMTSGKDADNAALCDALAIEHSTIYGYGIVSAMSPPSVNDMVVEALEQHRQRRDDVIAMLTARKVTAPVAAAGYQLPLVVGSPADAARLAARMENDGAGAWRVVAEHAETGDDRAFAATALVQSAVMAARWNRVLGAWPITTSFPGGND

SEQ ID NO: 4333 - protein, 582 aa, Mycobacterium paratuberculosis
VITRMSQLFLRTLRDDPADAEVPSHKLLIRAGYIRPVAPGLYSWLPLGLRVLRRIEHIVREEMNAIGGQEILFPALLPRAPYEATNRWTEYGDSVFRLQDRRGNDYLLGPTHEELFTLTVKGEYSSYKDFPVLLYQIQNKYRDEARPRAGILRVREFVMKDSYSFDIDDAGLKAAYHAHREAYQRIFARLQVRYVIVSAVSGAMGGSASEEFLAESPVGEDTFVRCLESGYAANVEAVITARPDPQPVEGLPEAVVHDTGDTPTIATLVDWANRAGLGRAVTAADTLKNVLLKVRQPGGDWELLAIGLPGDREVDDKRLGAALEPAEYVLLDDADFARYPFLVKGYIGPKALKDNGVRYLVDPRVVDGTSWITGADEPGRHVVGLVAGRDFTADGTIEAAEVRDGDPSPDGAGPLVSARGIEVAHIFQLGRKYTDAFTADVLGEDGKPVRLTMGSYGLGVSRMVAVIAEQHHDELGLRWPASVAPFDVHLVIANKDAQARAGATALADDLDRLGVEVLLDDRQASPGVKFKDAELLGVPWIVVVGRGWADGVVELRDRFAGQTRELATGPSLAADIAAALRG

SEQ ID NO: 4334 - protein, 412 aa, Mycobacterium paratuberculosis
MDTTDDTIRIRFATEDDWQAVYANQAGAYGVSVDPADVEAWKRRVDLEDILVAEDVSDPARPTVVGTSLCYKLRLTVPGGVTLKAAWLAMIAVAATHLGRGVWQQLSIRGFGILQERNYPILCGVPTQPTVYEILGAGVASYARTYNIEPRFTDLRAKPERNRARVVEADEARGLLPDLYDRWCAVTPGALSRSRAWWADVLEDRVTQRDNGSMLNYVVHPDGFMTYRVIGASPHAFRRPFGNLIVQDFCPITPEAHTDLLATLLSLKMFDNSVIETPVDDPLPLKLKDQLAAQTTKVNDFLWMRIMNVPEVLPKRAYRADADLVLDVTDPLGVAGGRFLLRIRDGVGTCTPHDGPADIKIGLGDLGSIYMGAHRAWELHQADRITELRSGALLDLDAAFTTQRAPYCGTLF

SEQ ID NO: 4335 - protein, 538 aa, Mycobacterium paratuberculosis
MTALNDSERAVQNWTSARPDRPAPVRSTPPAETAPKPAAETAVKRTSKYYPAWLPSRRFIAAVIAIGGMQLLATMDSTVAIVALPRIQNELSLSDAGRSWVITAYVLTFGGLMLLGGRLGDTIGRKRTFIVGVALFTISSVLCAVAWDEATMVIARLSQGVGSAIASPTGLALVATTFPKGPARNFATAVFAAMTAVGSVMGLVVGGALTEVSWRLAFLVNVPIGLVMMYLARTALRETNRERMKLDATGAVLATLACTAAVFAFSMGPEKGWISLTTISSGVVALGAALAFVIVERTAENPVVPFDLFRDRNRLVTFIAIFLAGGVMFTLTVCIGLYVQDILGYSALRAGVGFIPFVIAMGIGLGVSSQLVARFSPRVLTIAGGYLLVLAMLYGWWCMHRGVPYFPNLVLPIVVGGIGIGMAVVPLTLSAIAGVGFDQIGPVSAVTLMLQSLGGPLVLAVIQAVITSRTLYLGGTTGPVKTMNDAQLQALDHGYTYGLLWVAGAAVIVGAAALFIGYTPEQVAHAQEVKEAMDAGEL

SEQ ID NO: 4336 - protein, 401 aa, Mycobacterium paratuberculosis
VTESAYLVGLRLTGKKVVVVGGGTVAQRRLPLLIASGADVHVISRSATRSVEAMTGITLQLREYRDGDLDGAWYAIAATDDPRVNEAVVAEAERRRIFCVRADVAVAGTAVTPASFSYAGLSVGVLAGGEHRRSAAIRSAIREALQTGVITPEGPVGSDAVKGGVALIGGGPGDPELITVRGRRLLAQADVVVADRLAPPELLAELPPHVEVIDAAKIPYGRAMAQDAINDVMIERARAGSFVVRLKGGDPFVFARGYEEVLACADAGIPVTVVPGVTSAIGVPALAGVPVTHRAVNHEFVVVSGHLPPGHPESLVNWDALAALTGTIVLLMAVERIELFAEALLKGGRPADTPVLVVQHGTTAAQHTLRATLADTPEKIRAEGIRPPAIIVIGAVAAFGV

SEQ ID NO: 4337 - protein, 470 aa, Mycobacterium paratuberculosis
VVNVPAVVVAAPASGSGKTTVATGLIGALRGAGRRVAAFKVGPDFIDPGYHGLTAGRPGRNLDPVLVGENLIGPLYAHGAAGADIAVVEGVMGLFDGRIGPSGASPAAGSTAHVAALLGAPVVLVVDARGQSQSIAALLHGFSTFDAATRVAGVILNRVGSARHEQVLRQASEQAGVPVLGAIPRSAELELPTRYLGLVTAVEYGRRARLAVEAMTALVARHVDLAAVAAVAAARPVTTPWDPAAAVGDPGGCGGERATVAVATGKAFSFGYAEHAELLAAAGARVAEFDPLVDALPDGTDALLLPGGFPEQFTAELSANEVVRRQINELAAAGAPVHAECAGLLYLVSELDGHPMCGVLAGQARFTPQLTLAYRDAVAVVDSPLYAAGQRAVGHEFHRTTVTFSDDYPPAWMYRTQESGHRDGAVRGGVHASYLHTHPAAAPAAVARFVGCALAARADPGRTRAHPGNH

SEQ ID NO: 4338 - protein, 204 aa, Mycobacterium paratuberculosis
MPQGVPLQVPDDGLTTRARRHTPVLAVHTGAGKGKSTAAFGMALRAWNAGLSVAVFQFVKSAKWKVGEEAAFAALGRLHEEQRIGAPVEWHKMGAGWSWTRKAGSDDDHAAAAADGWAEIAGRLAAARHDFYVLDEFTYPLKWGWVDVDEVVSVLAGRPGHQHVVITGRDAPQRLIDAADLVTEMAKVKHPMDAGRKGQKGIEW

SEQ ID NO: 4339 - protein, 613 aa, Mycobacterium paratuberculosis
VKPYPFSAIVGHDRLRLALLLCAVRPEIGGALIRGEKGTAKSTAVRGLAALLSAATGSDANLVEMPLGATEDRVIGSLDLQRVLRDGEHAFSPGLLARAHGGVLYVDEVNLLHDHLVDVLLDAAAMGRVHIERDGISHSHDARFVLIGTMNPEEGELRPQLLDRFGLTVDVHASRDVEVRAQVIRQRMAYEADPDGFAERYADADAELARRIAAARALVDDVVLPDTELQRIAALCAAFDVDGMRADLVVARAAVAHAAWRGAPTVEEQDIRVAAELALPHRRRRDPFDDPGIDREQLDEALAQAGSEPDPDPDPPGGGQAGETEQQPPQRDSAQDAKPRPPTTKPSAPPSKTFRTRALRVPGVGEGAPGRRSRARNASGSVIAATDGADTGCGGHGLHLFATLLSAAERAGAGPLRPGPDDVRRAVREGREGNLVIFVVDASGSMAARDRMAAVSGATLSLLRDAYQRRDKVAVITFRQQQARLLLPPTSSAHIAGRRLARFDTGGKTPLAEGLLAARELIVREKARDRARRALVVVLTDGRATAGPDPLGRSRIAAARLVAEGAAAVVVDCETSYVRLGLAEHLARQLGAPAVRLEQLHADSLTRAVRDAA

SEQ ID NO: 4340 - protein, 156 aa, Mycobacterium paratuberculosis
MTEALRRTWAKDLDAQTLYELLKLRVEVFVVEQAIPYPELDGRDLLAETRHFWLETSDGEVICTLRLMEEHAGGEKAFRIGRLCTKRSARGQGHTTRLLRAALAEVGDYPCRINAQTYLADMYAQHGFVRDGDDFLDDGVPHVPMLRPGSGLAEKP

SEQ ID NO: 4341 - protein, 458 aa, Mycobacterium paratuberculosis
DAVAAESSSPWNNAGTGHSALCELNYTPQRADGSIDIAKAVRINEQFQVTRQFWAYAVENGMLTDRGFVTPIPHASFVRGARAVEYLRRRQQALAPNPLFAGIELIEDADEFARRLPLMADRRDFSEPTALNWARHGTDVDFGALSRQLIGFCVRGGATALFGHQVHNLTRESDGSWTLLIRNRRTGEKHWCNAKFVLVGAGGDALPLLQKSGIGEARGFAGFPIGGRFLRADNPVLTEAHRAKVYGAPAPGAPPLGALHLDLRYVNGKPWLVFGPYAGWSPKFLKHGHFTDLPRSVRPHNLVALLGVGVTQLTLLRYLIGQLRLSAPDRMRMLREFAPTAVDSDWELTVAGQRVQVIRRDRRRGGVLDFDTTVVAAGDGSIAGLLGGSPGASTAVPIMLDVLQRCFADRYRSWLPALKEMVPSLGVTLSDEPALYEEVYSWGTKILGLDELDEERPK

SEQ ID NO: 4342 - protein, 344 aa, Mycobacterium paratuberculosis
VTGGAAGWVPDVLPGYWQRTLALGADPAGEGDIVATLIRRGDDAAPAADHAVLAVHGYTDYFFHTALADHFAARGFAFYALDLHKCGRSRRDGQTPHFVTDLANYDTELERALSVASGGNRRVLVYGHSAGGLIVSLWLDRLRRRNPVAHSAVGGLVLNSPFLELPGPPILRHSLTVALIAGLSRVRSKGVARSPVQGGYGTTLHRDYGGEFDYNLQWKPVGGFPITFGWLHAVRRGQARLHRGLDVGVPNLILRSDHSVQETPDPASMHRGDAVLDVTQIARWAGCIGNRSTIIPVADAKHDVFLSLPGPRAAAYRQLDLWLDGYLRDRSTDSTRAPASRDEG

SEQ ID NO: 4343 - protein, 459 aa, Mycobacterium paratuberculosis
METYDLAIIGTGSGNSLLDARFAGKRTAICEHGTFGGTCLNVGCIPTKMFVYAADVATTIREAARYGVDTHLDGVRWPDIVSRVFGRIDPIALSGEEYRRSSVNIDLYRSHTRFGPVQFDGRYLLRTDAGEQFTAEQVVIAAGSRPVIPPAILESGVTYHTSDTIMRIPALPEHLVIVGSGFVAAEFAHIFSALGVHVTVVIRSGRMLRQYDDMICERFTRLAAAKWELRTQRNVVGGSNRGSGVTLRLDDGSTLDADVLLVATGRISNADLLDAGQAGVDVENGRVVVDEYQRTSARGVFALGDVSSPYQLKHVANHEARVVRHNLLCDWDDTESMAVTDHRYVPSAVFTDPQLATVGLTENQAIARGFDISVAIQNYGDVAYGWAMEDTTGVVKLIAERTSGRLLGAHIMGPQASSIIQPLIQAMSFGLTAAQMARGQYWIHPALPEVVENALLGLY

SEQ ID NO: 4344 - protein, 410 aa, Mycobacterium paratuberculosis
VPALRPARRGTYSRARCPVPDTARAGRTPVTSTEIDRWPARATRFLGALAPTEWWRLASMLGAILALHLIGWLTLVLLVAPGQYSLGGKAFGVGVGLTAYTLGLRHAFDADHIAAIDNTTRKLMNDGQRPLAVGFFFSLGHSTVVFALAVLLACGVRTVVGPVRDDSSALHHYTGLIGTSVSGVFLYAIALLNVVVLVGILRVLARVRRGDYDPHTDAAELERQLDNRGLMNRWLGRFTKSITQSWHCYPVGLLFGLGFDTATEVALLVLAGTSAAAGLPWYAILCLPVLFAAGMCLLDTIDGSFMNFAYGWAFSNPVRKIYYNIIITALSVAVAWVIGSIELLVLFADEFGWRGSFWDWLGGLDLNTVGYAVVGMFVLTWAVALLIWRYGRIEERWAGADPRAGTGREA

SEQ ID NO: 4345 - protein, 377 aa, Mycobacterium paratuberculosis
VPGSLRDVLPAAAALLGVADAGHEPGGSAVTDWVGAERVDRVLVLLVDGLGWQLLAQLAGDAPLLAAVRAGEVGRLTRLDCTFPSTTPTSLVSLATGAAPGQHGILGFTLRVPGTDRVLNHVRWRDDPAPDAWQPLPTWFERLAAAGVRARAVLPSSFLGSGLTEAAYRGARLVPAEPADDYPRLVGEELRAGPGLVYGYTAELDTAAHLFGIGSPQWHTAAAAVDALLSGLLEALPPNAALLVTADHGGLNVPPEARVDLDSDPRLAAGIRVVAGEPRVRYLHTEPGAAPDVQAAWSELLDGRAAVYSRVQAVATGMFGPVADRHLPRLGDVVVVCSGDTAVLASAHEPPETARLVGFHGAATPAETAIPLMLFRR

SEQ ID NO: 4346 - protein, 148 aa, Mycobacterium paratuberculosis
VILRGGDETRRWRPAIAVAAALGVFIALVAGSALRPACAAAALPEPPAWTAPTVARVAGRPSTISRAAPATSRSAAPANNTNKKPFHSTWMTKERPLSWNRLSPHAVLSPMPISFSPLGFAPRGAQSRAPATFLPDRDVLTLFGVARR

SEQ ID NO: 4347 - protein, 312 aa, Mycobacterium paratuberculosis
VAVMDFATLPPEVSSGLMHSGPGAGSLIRAAAAWDGLARQLRAAATSYRAATAALGDAAARYIDWLGGNAARGEQAAEGLTAAADAHRSACAAMVPPPVIAGNRTHRLALVSANCLGQHSPAIAEVDADYERMWARNAAAMYAYADASAAAVTLTPFTAPPGDCGAATRSWALTAAPELISAGGQVMAAIPDALEQLSAAPLRTLDAAMSAVTPALSKLNSLTAPSDLAIGHLNSMNKAAALQTLFPGPAAAPRVCAVVGRAMTVGVLSAPPGAAALAPLARQPRPDRAGEHIRLVPPGEPAGPHAAGESGG

SEQ ID NO: 4348 - protein, 258 aa, Mycobacterium paratuberculosis
VMDLTQRLAGRVAVITGAGGGIGLAAARRMHAEGATIVVADIDADAGAAAADELSGLFVPTDVADEDAVNALFDTAARRYGRIDIAFNNAGISPPDDDVIENTEPPAWQRVQDVNLKSVYLCCRAALRHMVSARRGSIINTASFVAVMGSATSQISYTAAKGGVLALSRELGVQFARQGIRVNALCPGPVNTPLLQELFAKDPQRAARRLVHVPVGRFAEPGEIAAAAAFLASDDASFITASTFLVDGGISAAYVTPL

SEQ ID NO: 4349 - protein, 483 aa, Mycobacterium paratuberculosis
MASGTVPAGPAAVHRDRGRRPVVRRGRPLSTARLINPATEEVLRSVEHADAAAVDDAVDRARAAQRRWARLAPADRAAGLRAFAAAVDAHRDELAALEVANSGHPIASAEWEAGQVRDVLTFYAGSPERLSGKQIPVAGGLDVTFHEPLGVVGVITPWNFPMPIASWGIAPALAAGNAVLVKPAEPTPVTTIRLAELAVQAGLDRDLLQVLPGPGTVVGERFVTHPDVRKIVFTGSTEVGKKVLAGAAAQVKRVTLELGGKSANIVFADCDLQRAAATAPAGVFDNAGQDCCARSRILVQRTVFDRFMELLEPAVTGIVVGDPASRDTQMGPLVSAAHRAKVASYVPDGAPVAFRGTAPTGPGFWFPPTVLTPSRTDRCVTEEIFGPVVTVLAFDDEQDAVALANDTSYGLSGSIWTNDLSRALRVSRAVEAGNLSVNSHSSVRYHTPFGGFKQSGLGRELGPDAPAQFTETKNVFIAIDEEP

SEQ ID NO: 4350 - protein, 254 aa, Mycobacterium paratuberculosis
VVLNGSEPLGGDPPRRPVVGLTAYLERVQTGIWDIPAGYLPADYFEGVTRAGGIAVLLPPQPMDTGIVGSLLDGLHALVITGGYDLDPAGYGQRPHPSTDAPRTDRDAWEFALLRGALQRGLPVLGICRGAQVLNVAFGGTLHQHLPDVLGHGGHRAGNGVFSTLPVRTVAGTRLAALLGETVDAPCYHHQAIDKVGDGLVVSAWDPDGVVEAVELPGDAFVLAVQWHPEQSLQDLRLFTAIVDAARSYAGVAR

SEQ ID NO: 4351 - protein, 461 aa, Mycobacterium paratuberculosis
LTGSDTAMLSLAALDRLVAAGAPETRVDTVIVAFPDMQGRLVGKRMDARLFVDEAAATGVECCGYLLAVDVDMNTVGGYAISGWDTGYGDLVMRPDLSTLRRIPWLPGTALVIADVVGADGSPVAVSPRAVLRRQLDRLAGRGLFADAATELEFMVFDEPYRQAWASGYRGLTPASDYNIDYAISASSRMEPLLRDIRRGMAGAGLRFESVKGECNRGQQEIGFRYDEALRTCDNHVIYKNGAKEIADQHGKSLTFMAKYDEREGNSCRVHLSLRDAQGGAAFADPSRPHGMSTMFCSFLAGLLATMADFTLFYAPNINSYKRFADESFAPTALAWGLDNRTCALRVVGHGAHTRVECRVPGGDVNPYLAVAAIVAGGLYGIEQGLALPEPCAGNAYRARGVGRLPGTLAEAAALFEHSALARQVFGDDVVAHYLNNARVELAAFHAAATDWERMRGFERL

SEQ ID NO: 4352 - protein, 183 aa, Mycobacterium paratuberculosis
MMTTLDGFGVPVVVAGPENGVVVVILGDEDRAPAAYDAVCERLHTASLRTVVIGFDPRLTPKSVIGILDALGIGWAVVMGDRAGGELAWELTATRLGRFVGLVVIDRGHPRAADRDGAIRDGHCPPVEIGTTVLVSSPAARAVAQASQQYVYADYRVVHLGRRTVQESTAQLAAEIILRTSTW

SEQ ID NO: 4353 - protein, 497 aa, Mycobacterium paratuberculosis
VSGALLVAGTSSDAGKSVVVAGLCRLLARRGVRVAPFKAQNMSNNSAVTVEGGEIGRAQAIQARAAGLEPSVRFNPILLKPGSDRTSQLVIKGQVAESVTATSYVQHRDRLAALVLNELTCLRDEFDAVICEGAGSPAEINLRATDLANMGLARAADLAVILVGDIDRGGLLAHLFGTVAVLDPQDQALIAGFVVNKFRGDPALLQPGLRRLHDITGRPTYGVLPYADRLWLDAEDSLSVLAHRVVGAPDPPLGDDWLRVAAVRLPRISNSTDVEALACEPGVLVRWVSEPSDVADADLVVIPGSKATVADLSWLRERGLAAAITAHAAAGRPVLGICGGFQMLCRRIDDRVESGAGEVAGLGLLDADIAFHPAKTLRRWQRPLAGYEIHHGRVSRCAEHSWFDSDAEPQGLVRGAVFGTHWHGLLDNDDFRRAWLVRVADAAGRRFVPGDTDVAARRDAQLDLAADLLAAHLDVDAVLGLLDGPPPRPRLATRLCR

SEQ ID NO: 4354 - protein, 285 aa, Mycobacterium paratuberculosis
MPARTALSPGALSPTLPVPARIPRPEYVGKPTAREGSEPWVQTPEVIEKMRVAGRIAAGALVEAGKAVAPGVTTDELDRIAHEYMIDHGAYPSTLGYKGYPKSCCTSLNEVICHGIPDSTVIEDGDIVNIDVTAYIDGVHGDTNATFLAGDVAEERRLLVERTREATMRAINAVKPGRALSVIGRVIESYANRFGYNVVRDFTGHGIGTTFHNGLVVLHYDQPSVSTIMQPGMTFTIEPMINLGGLDYEIWDDGWTVVTKDRKWTAQFEHTLLVTDTGVEILTLP

SEQ ID NO: 4355 - protein, 195 aa, Mycobacterium paratuberculosis
VGESGEEMVALRVSDADRNGIMRRLHNAVALGLIDIDEFEQRSSQVSYARTRGELDDLVGDLPGPGAIVTSAADRVELRGWAGSLKRHGEWTVPTRLALVRRLGSVELDLTRARFAGPVVVIELDMRFGSVQIRLPDGASASIDDVEVYVGSAVDRRKDAPGEGRPHVVLTGRVVCGSVVIRGPRRSLLRRRLSG

SEQ ID NO: 4356 - protein, 620 aa, Mycobacterium paratuberculosis
VSTPLFRPQFLTSAPMVTTRTVATSASGLLLVAVIALSGCTPRPDGPGPAAEKFFRALAVGDTATAAQLSDNPNEAREALNAAWSGLQASHLDAQILNAKYAEDTGTVGYRFTWHLPKNRTWTYDGQLKMARDEGRWEVRWTTTALHAKLGEHQTFALRADRPRRASVNELGGSDVLVPGYLYHYTLDATQAGNGAALFGTAHAVVDVLRPFNGALADPQLLAEQASSSTQPVDLVTLHPDDNDKVFPAIGRLPGIVVTPQPEMLPTDPHFAPAVVAAVKKAVIDQLDGQAGWRVVSVNQNGVEVEVLHEVEGSPAPSVSLTIDRAVQNAAQHAVDTRGGKAMIVVIKPSTGEILAIAQNGGADADGLPATNGLFPPGSTFKMITAGAAVDRDMATPNTMLGCPGHLDIGHRTIPNYGGFDLGVVPMSRAFASSCNTTFAELSSKMPPRGLTQAATRYGIGLDYQIDGITTVTGSVPPTVDLAERTEDGFGQGKVLASPFGMALVAATVAAGKTPVPQLIVGRQTAVQGDTTPISPKMVDALRPMMRLVVTNGTAKEIAGCGAVYGKTGEAEFPGGSHSWFAGYRGDLAFAALIVGGGSSEYAVRMTKVMFESLPPDFLA

SEQ ID NO: 4357 - protein, 284 aa, Mycobacterium paratuberculosis
MSAPPLFRLVGERRVSVVRDAAAVWRVLDDDPVASCMVAARVADHGIDPNAIGGELWTLRGADESLCFAGANLIPLRGAPGDLTAFADEAMRGARRCSSLVGRADLVMPMWERLEAAWGPARDVRDRQPLLALSSYPSCDIDTAVRQVRPEELDAYLVAAVDMFIGEVGVDPRIGDGGRGYRRRVASLITAGRAWARFEHGQVVFKAEVGSQSPGVGQIQGVWVHPEWRGLGLGTAGTATVAAVIVGSGRTASLYVNNFNTVARAAYARVGFAEIGTFATVLLD

SEQ ID NO: 4358 - protein, 388 aa, Mycobacterium paratuberculosis
VTTGLGMPQTPAPTLAPRRRTRQLMVRDVGVGSDYPISVQSMCTTKTHDVNSTLQQIAELTAAGCDIVRVACPRQEDADALAEIARHSQIPVIADIHFQPKYIFAAIDAGCAAVRVNPGNIKEFDGRVGEVAKAAAAAGIPIRIGVNAGSLDKRFMAKYGKATPEALVESALWEASLFEEHGFSDIKISVKHNDPVVMVAAYEQLAEQCDYPLHLGVTEAGPAFQGTIKSAVAFGALLSRGIGDTIRVSLSAPPVEEVKVGIQILESLNLRPRSLEIVSCPSCGRAQVDVYTLANEVSAGLDGLDVPLRVAVMGCVVNGPGEAREADLGVASGNGKGQIFVRGEVIKTVPESQIVETLIEEAMRIAAQMNSEGGPEATSSGSPVVTVS

SEQ ID NO: 4359 - protein, 109 aa, Mycobacterium paratuberculosis
MSVVGASIIGGDTVDHGLWVAFWFFLAQLNLILGAINLVPLLPFDGGHIAIAVFEKVRNLIRSARGMVAAAPVNYLKLMPATYVVLVFVVGYMLLTVTADLVNPIRLFQ

SEQ ID NO: 4360 - protein, 278 aa, Mycobacterium paratuberculosis
MMFVIGIVLFALAILISVALHECGHMWVARATGMKVRRYFVGFGPTLWSTRRGETEYGLKAVPLGGFCDIAGMTSVEELAPDEADRAMFKQATWKRVAVLFAGPGANFVICLVLLYAIALIWGLPNLHPPTKAIVGETDCVAPEVAPGKLADCTGPGPAALAGIRPGDVIVKVGDTPVSTFDDMAAAIRKVHGNVPIVVDRDGTAITAYVDVTPTQRYLSGGVRPAGRPAATLDRRRHRRRRGQGRARPLRRVLRDPGQRGVRRRPDRRGGQGAGHHP

SEQ ID NO: 4361 - protein, 419 aa, Mycobacterium paratuberculosis
MARAGGGRHNEWVTNPTSDGQPRGRLRVLVLGSTGSIGTQALQVIAANPDRFEVVGLAAGGANLDTLLRQRAETGVTNVAVADEHAARRAGDIPFCGPEAATRLVEETEADVVLNALVGALGLRPTLAALESGARLALANKESLIAGGPLVLAAAAPGQIVPVDSEHSALAQCLRGGTGDEVAKLVLTASGGPFRGWTAEELEHVTPEQAGAHPTWSMGPMNTLNSASLVNKGLELIETHLLFGIPYDRIEVVVHPQSIVHSMVTFVDGSTLAQASPPDMRLPISLALGWPHRVPGAAACCDFSTASSWEFEPLDNEVFPAVELARHAGQAGGCMTAIYNAANEEAAAAFLAGRVSFGAIVETIADVLHAADQWAPKFSETPANVDDVLDAQRWARQRAQRAVAQARPATASAKTPGVV

SEQ ID NO: 4362 - protein, 409 aa, Mycobacterium paratuberculosis
VDRGLVGLAVAAGMVAALNPCGFAMLPAYLLLVVRGAGTRAPGVAAAGRALAATAGMALGFLTVFGLFGALTVSAAGAVQRWLPYATVVVGVLLVALGGWLLAGRSLSALTPRPVGPRWAPTARLGSMYGYGISYAIASLSCTVGPFLAVTAAGLRSGSLLTGAAVYLGYVAGLTLVVGVPAVAAATAGAATADRLRRMLPFVDRISGAVLVLVGLYVAYYGGYEVRLFGAGGDPRDAVIGAAGRLQGALVGWVHRHGLWPWALALLALAAVPFGHAWRRGQRADRLPDPAAAAAPQVADQHHEDQRREPDQKPVLDVADVVAAQHGQQQPEDDQADDVPGPVVDPAPSPRRRRHLDGVDAGEVLDLGTGHGESPSDRIGLSNPDSGTTAGRARGARPHHGPRRWRAAQ

SEQ ID NO: 4363 - protein, 172 aa, Mycobacterium paratuberculosis
VRLQGMSRLSFVCRLLAATAFAVALLLGLGDVPRAAATDDRLQFTATTLSGAPFNGASLQGKPAVLWFWTPWCPYCNAEAPGVSRVAAANPGVTFVGVAAHSEVGAMANFVSKYNLNFTTLNDADGAIWARYGVPWQPAYVFYRADGSSTFVNNPTSAMPQDELAARVAALR

SEQ ID NO: 4364 - protein, 364 aa, Mycobacterium paratuberculosis
MVQQLVFSEPRPGKPPRHLADLDADGRASAVAELGLPAFRAKQLAHQYYGRLIADPRQMTDLPAGLRDAIADTMFPILLTAASEVTCDAGQTRKTLWRALDGVTVESVLMRYPHRNTVCISSQAGCGMACPFCATGQGGLSRNLSTAEILEQVRAGAAALRDDFGDRLSNVVFMGMGEPLANYARVVAAVRRIVAAPPQGFGISARSVTVSTVGLAPAIRKLADERLGVTLALSLHAPDDELRDTLVPVNNRWKIAEALDAARYYADVTGRRVSVEYALIRDVNDQPWRADLLGRRLHRALGPLVHVNLIPLNPTPGSQWDASPKPVEREFVRRVRAAGVSCTVRDTRGREISAACGQLAAEGG

SEQ ID NO: 4365 - protein, 311 aa, Mycobacterium paratuberculosis
VATSDPGAGDEPEHAVENTTEGAAGQRAKKKTSRAGRDLRAAIAVGAGIGAVLIVTLVFAPRFWVPIVAMAILVASHEVVRRLREAGYVIPVIPLLAGGQLTVWLTWPFHAAGALAGFGVTVVACLFWRLFMQDNRKRPEPFAGSPSANYLRDASATVFLACWVPLFASFAALLVYPADGAGRVFCLMITVVASDVGGYAVGVLFGKHPMVPAISPKKSWEGLAGSLVLGITAATLAATFLAGKAPWVGALLGVVLVFTCTLGDLVESQVKRDLGIKDMGRLLPGHGGLMDRLDGVLPSAVAAWTVLTLVP

SEQ ID NO: 4366 - protein, 185 aa, Mycobacterium paratuberculosis
MIDEALFDAEEKMEKAVAVARDDLSTIRTGRANPGMFSRIVIDYYGAATPITQLASINVPEARLVVIKPYEASQVGAIETAIRNSDLGVNPTNDGTLIRVAVPQLTEERRRELVKQAKSKGEDAKVSVRNIRRKAMEELHRIRKDGEAGEDEVGRAEKDLDKTTHQYITQIDELVKHKEGELLEV

SEQ ID NO: 4367 - protein, 265 aa, Mycobacterium paratuberculosis
MTESREPHVAGSAAPRPEPANGLASGQPSSRARYSRVLLKLGGEMFGGGQVGLDPDVVAQVARQIAEVVRGGVQVAVVIGGGNFFRGAQLQQRGMERTRSDYMGMLGTVMNSLALQDFLEKEGIVTRVQTAITMGQVAEPYLPLRAVRHLEKGRVVIFGAGMGLPYFSTDTTAAQRALEIGAEVVLMAKAVDGVFSADPRQYPEAELITAISHREVIDRGLRVADATAFSLCMDNGMPILVFNLLTNGNIARAVGGEKIGTLVTT

SEQ ID NO: 4368 - protein, 152 aa, Mycobacterium paratuberculosis
LACPTDFRVSRYRIAAARRCAFEGSVAGESARTRRKYAVLSNEDLPRRMTGSIARDRRSSVHRSQYAKRRNGSMAEENKSGPAEAVKGVVEDVKGKAKEAVGAVAGRDDLTREGQAQQDKAEAQRDAAKKEAEAEAARGGAEAAEERQRANQ

SEQ ID NO: 4369 - protein, 253 aa, Mycobacterium paratuberculosis
LSDISRRGAYGPGEARTSRGLEMSLDVVVLTNEDDFESALPDLSRFARPARRAALSTDGDGQFGPADVAIIDARSNVAAAQAVSHRLTADHPATAVVALVAPADCAAVDVDCNFDDVMLPGTCAEELQARLRLAIGRRRGGLDGTLKFGDLLLHPASFTASLDGRELNLTLTEFKLLNFLVQHAGQAFTRTRLMQQAWGYEGNGRARTVDVHIRRLRAKLGTRHQSLVGTVRGVGYRAPTPPQPEWIVGHQKP

SEQ ID NO: 4370 - protein, 312 aa, Mycobacterium paratuberculosis
MSNPDHRPTQVRAQAQRHAAETRATMQERRNGQRGGLSGWVAERAARWDLSGQDEDTLQRQKYLWNALVDYWFRMEIDGWENIPDTPPALLVGVHSGAPFVWDAWTVGLQWWRRFGPDRPLHGTAHDALMAIPLFGRYFRSMGVLPAAPDAIATALAEGRDVALWPGGEVDSLRPWTERDRANLAGRTGFVKMAIRAGVPIVPIATVGGADAMPVLIRGDRLSKALRLDRLLRLKVFPLAISLPWGIAPAALPQLPLPAKIRTRFMPPVELDNDPARVQDDEYVERKYREVQDSIQQGMDALARRRAFPVFG

SEQ ID NO: 4371 - protein, 190 aa, Mycobacterium paratuberculosis
MKVTKNAVLTAAAAGGIAAASVFAAAPAAAAPNIQGFGVSEQLVDGPLVTDYTVSNLQPSNVSIPGYTPKGTLYQADVSVRSDGGVVTPMVHDFIARGPNGQNYRVIDNVAVPNGLSPAPIPQGTESTGTLYFDVTGAPPNGVVYNDGMQDVLMWTSNVPSSAPGAPNSPAPGAPNSPAPGAPPAPAAHT

SEQ ID NO: 4372 - protein, 279 aa, Mycobacterium paratuberculosis
MGFVAQQQSVPGVQAKMEPIPDCGENSYRGSGKLLGKKAIITGGDSGIGRAVAIAYAREGADVLIAYLNEDDDARDVARHVTDAGRKCVLVPGDLSDPAHCRAVVDRAVRELGGVDILVNNAAYQMMHKNLDEISDEEWDYTFRLNVGAYFYLTKAALPHLRAGSSIIGSSSVNSDTPNPTLAPYAATKAAIANFSASLAQLLGDKGIRVNSVAPGPIWTPLIPSTMPPDSVESFGDNVPLGRAGQPAELAPIYVLLASDEASYISGARVAVTGGRPIL

SEQ ID NO: 4373 - protein, 137 aa, Mycobacterium paratuberculosis
MPKTTKGGAPKKGELPSTLQRSSAKAQRTFAKAHDAAAQEYGSEERAHRVAYSAVKHSFEKVGDHWEPKAKKGPSDQRARSGGPRASGASAEGVDANASKKHLLDVARRLDVRGRSTMTKSELVDAIKKHNRRARAR

SEQ ID NO: 4374 - protein, 140 aa, Mycobacterium paratuberculosis
MTEADDAPLGYLLYRVGAALRPEVSGALGPLGLTLPEFVCLRILSMFPGMSSAELSRRAGVTPQAMNTVLRRLQEVGAVARPSSVSSGRSLPAHLTGAGCTLLKRAEAAVRGADARILAKLTETQQREFKRMLQKLGSDG

SEQ ID NO: 4375 - protein, 293 aa, Mycobacterium paratuberculosis
MRHVHAFGDDALGDLDAVGLADALRAGRVSRAEVVEAAIARTEAVDPLLNGLAYAAFQQARSAAERPDPPAGFSAFFDGVPTFIKDNIDVAGQPTMHGTDAWTSYNAVADSVFTRLYLATGLISVGKTQLSEFGFSAAAEHPRLGPVRNPWDTDYTAGASSSGSGAFVGAGVVPIAHANDGGGSIRIPAACNGLVGLKPSRGRLPLDATLRRMPVGVVANGVVTRSVRDTAAFYREAERIWRNRLAPIGDVTGPGRQRLRIAVLTRSIQRECSPRIRELTLKTAGLLEELGHR

SEQ ID NO: 4376 - protein, 275 aa, Mycobacterium paratuberculosis
LANFTAADVKRLRELTGAGMLDCKNALAESDGDFDKAVEALRIKGAKDVGKRAERATAEGLVAAQGGALIELNSETDFVAKNAEFQALADQIVAAAASSKAADVDALKAAKIGDTTVEQAIAELSAKIGEKLELRRVAHFDGTVEAYLHRRAADLPPAVGVLVEYQGSGKDSDKEAAHAVALQIAALKARYLSRGDVPEDVVASERRIAEETAKAEGKPEQALPKIVEGRLNGFFKDAVLLEQPSVSDSKKTVKALLDEAGVTVTRFVRFEVGQA

SEQ ID NO: 4377 - protein, 276 aa, Mycobacterium paratuberculosis
MAVVTMKQLLDSGTHFGHQTRRWNPKMKRFIFTDRNGIYIIDLQQTLTFIDKAYEFVKETVAHGGTVLFVGTKKQAQESIAAEATRVGMPYVNQRWLGGMLTNFSTVHKRLQRLKELEAMEQTGGFEGRTKKEILGLTREKNKLERSLGGIRDMSKVPSAIWVVDTNKEHIAVGEARKLGIPVIAILDTNCDPDEVDYPIPGNDDAIRSAALLTKVIASAVAEGLQARAGVGRGDGKPEVEAAEPLAEWEQELLASATATAAPTEAGAPEPTTDPS

SEQ ID NO: 4378 - protein, 167 aa, Mycobacterium paratuberculosis
VRWAALMLVVGLVGAVPAAAGDLHLEWPLRPPPVVVRAFEAPAQDWHPGHRGVDLAGTAGQPVYAAGAGTVVFAGLLAGRPVVSVAHPGGLRTSYEPVRAVVRVGQPVTAQTVLGELRPGHPGCRASPAGGACLHWGALWGPASGARYLDPLGLVASTPIRLKPLGG

SEQ ID NO: 4379 - protein, 301 aa, Mycobacterium paratuberculosis
VPDSEPILEEFDEYLALQCGRSAHTRRAYLGDLRSLLAFAGERGTGLDGLSLPLLRSWLSAAAAGGVARTTLARRTSAVKAFTAWAVRRGLLTADPAARLQVPKTHRTLPAVLRQDQALGAMAAAKTGAAQGDPIALRDRLIVEMLYATGIRVSELCGLDIDDVDTGRRLVRVLGKGNKQRSVPFGAPAGEALHAWLADGRPALANAESGPALLLGARGRRLDVRQARTVVHQTIAAVSGAPDMGPHGLRHSAATHLLEGGADLRVVQELLGHSSLATTQLYTHVAVSRLRAVHDQAHPRA

SEQ ID NO: 4380 - protein, 386 aa, Mycobacterium paratuberculosis
MAFGDYQNEIYFRGLGGVAPSLPMAFAELESRAERAMSPSVWSYVTGGAGDERTQRANREAFDRWGLIPRMFVGAAERDLSVQMFGLTLPSPVFMAPIGVIGICAQDGHGDLATARAAAATGVPMVVSTLTADPMEDVAAQFGDTPGFFQLYTPKDRELAASLVHRAEAAGFKGIIVTLDTWIPGWRPRDLSTANFPQLRGMCLSNYTSDPVFRAALARPPEEDPQGTVLQWISTFGNPLTWDDLPWLRSLTDLPLIIKGICHPDDARRARDGGVDGIYCSTHGGRQANGGLPALDCLPGVIEAADGLPVLFDSGIRSGADVVKALALGATAVGIGRPYAYGLALGGVDGIVHALRSILAEADLIMAVDGYPTRKDLTPDTLRRVV

SEQ ID NO: 4381 - protein, 231 aa, Mycobacterium paratuberculosis
VDVAGLPQPLTLDSFAELPAEKKPSVRTLTVRHVDAASRQIALDVVVHGEHGIAGQWAATAQPGQPIYLMGPGGAYTPDPAADWHLLAGDESALPAIAAALEALPPSAVGKAFIEVAGHEDEIPLTAPDGVEVHWVYRGGRADLVPEDRAGDHAPLIEAVTSAPWLPGQVHVFIHGEAQAVMHNLRPYVRKERGVDAKWAASISGYWRRGRTEETFRQWKKELAQAESAQA

SEQ ID NO: 4382 - protein, 388 aa, Mycobacterium paratuberculosis
MTPADPRALRAWAYLSRVAEPPCPGLGALVRRVGPVEAADRVRRAAVDDALAKHTEARREIDRAAADLELIARRGGRLVTPDDDEWPVLAFAAFGAAAPRPPGTAPMLAPLVLWAQGPARLDEVAHRAAAVVGTRAATAYGEQVAGDLVAGLVQRDVAVVSGGAYGIDGAAHRAALDCDGVTVAVLAGGLDVAYPSGHSALLHRIGQHGLLFTEYAPGVRPARYRFLTRNRLVAAMAGATVVVEAGLRSGAANTAAWARALGRVVAAVPGPVTSSASAGCHALLRNGAELITRAEHVVELIGHIGELAAEEPHPVTPLDGLGEAERRVYEALPGRGAATVEQLAAGCGLLPEQALGPLAMLELAGLVRRQDGRWRIVRTAAGPAPPPA

SEQ ID NO: 4383 - protein, 503 aa, Mycobacterium paratuberculosis
MALGRAFSVAVRGVDGQIVEIEADITSGLPGVHLVGLPDAALQESRDRVRAAVSNCTNNWPQARLTLALSPATLPKMGSVYDIALASAVLSAQRKNPWHRLDKTVLLGELSLDGRVRPVRGVLPAVLAAKRDGWPAVVVPADNLAEASLVDGIDVWGVRTLGQLQDWLSGTGALDGRIEPDTTVPEPTADLVDVVGQTQARFAVELAAAGAHHLMLTGPPGVGKTMLAQRLPGLLPPLTESESLEVTAIHSVAGLLSGDTPLITRPPFVAPHHSSSVAALVGGGSGMARPGAVSRAHRGVLFLDECAEIRLSALEALRTPLEDGEIRLARRDGVACYPARFQLVLAANLCPCAPADPQDCVCAAVAKRRYLGKLSGPLLDRVDLRVQMHPMRAGAFGGGDGESTAQVRRRVAQARQAAAQRWLPYGFRTNAEVSGPLLRRKFRLGSAAMDPLQKALDRGLLSIRGLDRTLRVAWSVADLAGRTSPGPEEVATALSFRQAGAQR

SEQ ID NO: 4384 - protein, 118 aa, Mycobacterium paratuberculosis
VGAVRPEQLGRLPPGMPIHGSTRTQMLTRRIAHPSNTCLPPVDATSTVVFVEVKTRTGDGYGGLPQAVTPRKVRRLRRLAGLWLAGQDRGWAAIRIDVIGVRVGRRRTPEITHLQGIG

SEQ ID NO: 4385 - protein, 874 aa, Mycobacterium paratuberculosis
MIKKMGYRWRLRDLMADQQMFKTTDLIPHLVERGITLSREQVFRLVTQPPQRLSMDTLVALCDILGCTPNDLIVLEVVNKPVRKTAGAGGEWCAGGHAQKNSRTTAWQVMTRPHSTAPIAHVRESLVSSVISAVGSGMTRQRAQQLLVEAKGWSTANARHLHEYLGENPGAFTAPTHECPAAFPRLLTLLAAAGHADAVSLLGCAKCGRTDLALRRNSPEGRCCPWCVIRTELRPCARCGEDGYIIARRADGPVCRRCYNKDPQFLQVCAGCGRKRPPNARRDDGTVLCQRCSLPPTQSCCRCGNVRRVHAQTADGPICRTCYRSPARKCGVCGEIAQIQARATDTHPDTCVRCYRNIGECVVCGRTRAGGKYRGGSLHCVTCWPHHPRHCDSCEKPGIACATWPLGTVCRDCYHRRRLHPQPCANCHRTAVMVGRNPDGQDICAPCCGVDLDFSCRTCGIEGLNYADGKCTCCVMTDRVNVLLSLDDGTVVPQLQPLADALSAANPESVQTWLQASSSARLLAQLVAERRAISHELLDELDQDNATRYIRQLLVTTGILTSRQEEFAQLQIWASRKIQHLPPHQSRVVRPFAEWRVIRDARKRAARRRYTIGSAANDRQKISTTIAFLTWLDDQEIPLDSVTQLHLDRWLDAHPTKHKYLAAFIGWLEKQRLTQAELVVPQRRSQLPSRLLSDDELEQQLKRCLTDDTLPLDVRVVGALIRLYAPPLVRIAELTTDRYHTDDDGSYLTIGRHPVLLPPTLARLIEQLIARGPVNTLLRNGSADNPAYLLAGRPPSRPVNPRSLQQRLTKHGLPVIHARNTAMITNAATLPPPVVAELFGIHPTTAYQWAQYAQSSWAAYLQACQSTAQPGLRC

SEQ ID NO: 4386 - protein, 372 aa, Mycobacterium paratuberculosis
VTLSAPGSAHLVLAQNVVHLDQAAAVFEAMLEGWRRQQSARFLRAGTIGARLRLIRRLEAFSGLYPWQWAPADGEAFIDHLRSTTVEAVSTARSYEIDISLFMEYLLDPRYGWAGVCADQFGDVPQAIFHEGNSIQHKLDYEGDPRRRPLSYDEIQALFDAADARSGTIQGRGVKGALGAARDAAVLKTIYAFGLRRTEASRLDLVDLRRNSQAPQFGGFGVVMVRYGKAPKGAPPKRRTVLLVPEMDWVVETLDQWLTEIRPRFSPPDRHPALWVTERGGRLSPRSINEAFVAARDDARLDRSLNLHCLRHSAVTHWTEFGYPARFVQEQVGHAHASTTSIYTHVSNEYRNKLLKASLMGRLGDHWDGAPT

SEQ ID NO: 4387 - protein, 98 aa, Mycobacterium paratuberculosis
MRAALGITGRCGRPRPAARPRPSAAPGRVAAMTTETTMTRIQLGAMGEALAVDHLTRMGLRVLHRNWRCRYGELDIIACDKCAELHWMQHFGTVAGSA

SEQ ID NO: 4388 - protein, 272 aa, Mycobacterium paratuberculosis
VQVTSRRRVTHLTAGQAIARPETLVVEEPLEIRVGGAAVTVTMRTPGSDFELAQGFLLTEGIIGAREDVHSIRYCAGCGEDGANSYNVLDVTLAAGLGRPELDVTRNFYTTSSCGVCGKASLEAVRSVSRFSPAADPATVAAATLQAMPHQLRSAQKVFDSTGGLHAAALFRADGTMLVVREDVGRHNAVDKVIGWALEQQRLPLRATVLLVSGRASFELAQKTVMAGIPVLAAVSAPSSLAVSLAEESGVTLVAFLREDSMNIYTRADRIG

SEQ ID NO: 4389 - protein, 329 aa, Mycobacterium paratuberculosis
VGVTVAVTGPTGEIGRSAVTALEREPGVDAIIGMARRPFSPSSRGWQKTTYQQGDILDREAVDAVVAQADVVIHLAFIIMGSRDESARVNLQGTRNVFEATVAAGRPRRLVYTSSVAAYGYHSDNPVPLTEDVPARGSAEHYYSAQKAASEAMLAEITKDSPLEVFVLRPCIVAGPGATALADAMPWNQLPGPLRAIVKAVQAIPVLKPVVPDPGYPLQLVHHDDVASAIALAATAPAPPGAYNIAGDGVVTVADVAKALGGRPVRVPAVAATAASAAISKAPLVPSMLEWLHTARTSMVMDTTKAKTQLGWRPVHTSAQALAALASAV

SEQ ID NO: 4390 - protein, 256 aa, Mycobacterium paratuberculosis
MAEQSEAGAVASAAGGEKADPATVFAALAEIIYQGSDANEMYAAICIAATLTVRGCDHASLLVRENDRYVTVGASDQLARHIDELERRAGDGPCIDAIEEETPQIDPDLTTPSLWPKLASVLVAETPVRGAMGFRLLVDKRKGAALNLFSDTPNMFDAESAGRAAVLAAFASVAINAVAKGEDAASLRRGLLSNREIGKAVGMLMLLHEMTEDEAFDLLRRHSQALNIKLAEVARAVIDNRGQLPPEIENQLPPNT

SEQ ID NO: 4391 - protein, 101 aa, Mycobacterium paratuberculosis
MSAEDLEKYETEMELSLYREYKDIVGQFSYVVETERRFYLANSVEMTPRNADGEVYFELRLSDAWVWDMYRPARFVKQVRVVTFKDVNIEEVEKPELRLPE

SEQ ID NO: 4392 - protein, 239 aa, Mycobacterium paratuberculosis
MATTWPPRTVIRKSSGLRTLESALYRSGLGPVAGVDEVGRGACAGPLVVAACVLGPGKLESLAALDDSKKLTESVRERLFPVIRRYALAYHVVFIPPAEVDRRGVHVANIEGMRRAVAGLSLRPGYVLSDGFRVPGLAVPSLPVIGGDAVAACIAAASVLAKVSRDRLMVAMDAEHPGYGFADHKGYSTPAHSAALARLGPCPQHRHSFINVRRVANGSGGRVVADCKPDLPLQRDEGR

SEQ ID NO: 4393 - protein, 299 aa, Mycobacterium paratuberculosis
VTDTADSSNPQSHAGDADPKVSTRNPDTRPDDDAGAPAPVPEPGTKPDAAAPTEGSKRSTLREFAILAVIAVLLYYVMLTFVARPYLIPSESMEPTLHGCTGCVGDRIMVDKVSYRFGAPRPGDVIVFKGPPSWNLGYKSIRSNNTALRWAQNALSFVGFVPPDENDLVKRVIAVGGQTVQCRAETGLTVNGKPLREPYLDRNTMAADPSVYPCLGSEFGPVTVPAGRLWVMGDNRTHSADSRAHCTSVPAEALKGVLCTGDPASGTVPVSNVIGKARFIVWPPSRWGGVGSVNPQQGQ

SEQ ID NO: 4394 - protein, 162 aa, Mycobacterium paratuberculosis
LSPAVAGRLGHFPPAARCARKPETIGRATASHPRVGGCRRPRPQGSVSHMNRLDFVDQASLRDDIPVFGPGDTVNVHVKVIEGAKERIQVFKGVVIRRQGGGVRETFTVRKESYGVGVERTFPVHSPNIDHIQVVTRGDVRRAKLYYLRELRGKKAKIKEKR

SEQ ID NO: 4395 - protein, 322 aa, Mycobacterium paratuberculosis
MRVRPLTLFTATAAVTLLIAAGSEALVQAKVYHLPVAAPVRVLTQPPPPQSAALMLEAATPPQPPQALPNAGFAQLPARIQQAADQAAASGAALSVAILDRGTHQLVSIGNGQIVGTASVAKLFIADDLLLHQAEGKAALSADDRQALDIMLQSSDDGAAERFWGQGGGAAIISEVASRYGLTSTTPPGDGRWWNTMSSVTDLIRYYDMLLDGSGGLPADQARIIVSDLAQSTPNGVDGYPQRFGIPDGLYAEPVAVKQGWMCCIGADWMHLSTGVIGADRRYIMVVQSLQPADDATARETITRAVKTIFPDGRIEAPPHGL

SEQ ID NO: 4396 - protein, 239 aa, Mycobacterium paratuberculosis
MRIDVVTIFPAYLDPLRQSLPGKAIQSGLVDLRVHDLRRWTHDAHRSVDDAPYGGGPGMVMKAPVWGEALDEIASAETLLVVPTPAGVLFDQATAARWSAERHLVFACGRYEGIDQRVVEDAARRMRVEEVSIGDYVLPGGESAAVVMIEAVLRLLDGVLGNPASRHDDSHSPALDRRLEGPSYTRPPSWRGLDVPEVLLSGDHARIAAWRREVSLQRTRERRPELLADPVGPQDDPGR

SEQ ID NO: 4397 - protein, 175 aa, Mycobacterium paratuberculosis
LELTVGRVVKAHGISGEIVVEIRTDDPAARFAPGNTLRAKPSRGGPERSCVIESAREHGGRLLVRLAGVTDRDAADALRGTLFVVDSAELPDIDEPDTYYDHQLEGLQVRTTGGRRVGAVAEVLHTAAGELLAVRDDADGAPREVLVPFVSAIVTAVSLDDGLIEIDPPDGLLDL

SEQ ID NO: 4398 - protein, 80 aa, Mycobacterium paratuberculosis
MSTVVVDAVEHLVRGIVDNPDDVRVDMVTSRRGRTVEVHVHPDDLGKVIGRGGRTATALRTLVAGIGGRGIRVDVVDTDQ

SEQ ID NO: 4399 - protein, 171 aa, Mycobacterium paratuberculosis
MAVKIKLTRLGKIRNPQYRIAVADARTRRDGRSIEIIGRYHPKEDPSLIEINSERAQYWLSVGAQPTEPVLKLLKITGDWQKFKGLPGAEGRLKVAPPKPSKLELFNAALAEAEGGPTTEAAKPKKKAATSGAKKAAKAAEPEAAASEAAEPEAAAAPAEGGEQAESSAES

SEQ ID NO: 4400 - protein, 139 aa, Mycobacterium paratuberculosis
MLSLEEISDRLEIQQLLVDYSTAIDNRRFDDLDDVFTPDAYIDYTALGGIEGRYPEVKKWLAEVLPNFPVYAHMLGNFSVRIDGDTASSRVICFNPMVLGGDTDQVLFCGLWYDDEFVRTPGGWRMTRRVETKVFQKVM

SEQ ID NO: 4401 - protein, 289 aa, Mycobacterium paratuberculosis
MRKLWTAAAALLLVGACGAPTAAADSTQPAGSIPIPDGPAQTWIIADLDSGQVLAGRDPNVAHPPASTIKTLLAQVVLDEVSLDATVVADAADTQVECNCVGIKPGRSYTARQLLDALLLVSGNDAANTLAHMLGGPEATVAKMNAKAAALGATNTHASTPSGLDGPNGSGSSTAHDLAVIFRAAMANPVFAQITAEPSAMFPGDNGLQPITNQDELLQRYPGAIGGKTGFTNAARKTFVGAAARGGRRLVIAMMYGLIKEGGPSYWDQAATLFDWGFAQSPQASIGSL

SEQ ID NO: 4402 - protein, 197 aa, Mycobacterium paratuberculosis
MARTQQQRREETVARLLDASIATIIEVGYARASAAVITKRAGVSVGALFRHFDTMGDFMAATASEVLRRQLESFTKRVADIPADQPVLEVVLGILRDLTSGPVNAVIYELTVAARTDEKLRETLQHELAQYAAKIDEVSRALPGVEGFPADTFPVLVALMRNVFDGAAVVEGVLPQPEIAARRIPVLTALLNAALPP

SEQ ID NO: 4403 - protein, 620 aa, Mycobacterium paratuberculosis
LRVLAIYVSVPAARDLEDAMPYDVIIRDGLWFDGTGGAALTRTLGIRDGVLVDVAESLDEAGCPEVIDAAGKWVLPGFIDVHTHYDAEVLLDPGLRESVRHGVTTVLLGNCSLSTVYADSQDAADLFSRVEAVPREYVYGALISNRTWSTAADYVKAVDALPLGPNVGSLLGHSDLRAAVLGLDRATDPAVRPTGDELAKMAALLDEALDAGLLGMSGMDAAIEKLDGERFRSRALPSTFATWRERRKLIEVLRRRGRILQSAPDLDNPALALMFFLTSSRIFGRGRGVRMSMLVSADAKSMPLAVHTFGLGTRILNKLLRSSVRFQHLPVPFELYSDGIDLPVFEEFGAGTAALHLRDQLQRNELLADTDYRRRFRREFDRVKLGPSLWHRDFYDAVIVECPDKSLIGKSFGAIADERGLHPLDAFLDVLVENGERNVRWTTTVANHRPKQLDKLAADPSIHMGFSDAGAHLRNMAFYNFALRMLKRTRDAQAAGAPFLTIERAVHRLTGELADWFGIDAGTLRPGDRADFVVIDPAGLDESVDAYHEEAVPFYGGLRRMVNRNDDAVIATGVGGVVVFGGSHRKGEFRDGYGHTVKSGRYLRAGQRVRARVGAPRVTA

SEQ ID NO: 4404 - protein, 363 aa, Mycobacterium paratuberculosis
VRWHLRGRSLPDEGPIELWVVDGRISTEPVAGADTVFGASGGGWIVPGLVDAHCHVGLGEHGEIPLDEAIAQAEIERDVGALLLRDCGSPTDTRSLDDRDDLPRIIRAGKHLARPKRYAAGFSRELDDEWQLPDAVAQEAKRGDGWIKLVGDWIDRSVGDLAPLWSDEVLKAAIDTAHAHGARVTAHVFSEDALPGLINAGIDCIEHGTGLTDDTIELMVSRGTALVPTLVNVVENFPGIAQAAAKYPTYAAHMRDLYARGPSRIAAAREAGVPIYAGSDAGTMVAPGRIADEVEALKGIGMTATQALGAACWDARRWLGRPGLEHGASADLLCFAEDPRSGPAVLRNPDLIMLRGNIFRSPA

SEQ ID NO: 4405 - protein, 517 aa, Mycobacterium paratuberculosis
VFESLSDRLTGALAGLRGKGRLTDADIEATTREIRLALLEADVSLPVVRAFVTRIKERAKGAEVSGALNPAQQVVKIVNEELIGILGGETRQLAFAKTPPTVIMLAGLQGSGKTSLAGKLAAWLRGQGHTPLLVACDLQRPAAVNQLQVVGERAGVPVFAPHPGASPESGPGDPVAVAAQGLAEARAKHHDVVIVDTAGRLGIDDELMAQAAAIRDAIDPDEILFVLDAMIGQDAVTTAEAFREGVGFTGVVLTKLDGDARGGAALSVREVTGVPILFASTGEKLEDFDVFHPDRMSSRILGMGDVLSLIEQAEQVFDAEQAEAAAVKIGSGELTLEDFLEQMLAIRKMGPIGNLLGMLPGAGQMKDALAAVDDKQLDRLQAIIRGMTPEERADPKIINASRRLRIANGSGVTVSEVNQLVDRFFEARKMMSSMLGGMGIPGLGRKSATRKAKGAKGKAKKGKKGARGPTPPEVRSPLGPGMPAGFPDLSQLPEGLNELPPGLADFDLSKLKFPGNK

SEQ ID NO: 4406 - protein, 263 aa, Mycobacterium paratuberculosis
MLEVIEKGSGSAEHPTPLLFVHGGWHAAWCWENFLDFFADAGYRAVALSLRGHGASPTSKPLHRVSIADYLDDVAAVAGELGGAPILIGHSLGGFVIQRYLETHRVPAAVLVGSVPPQGVLRLALRVWRRRPSMTMEAWNDPTLLKFLATPALAREYLFCAATPEAIVESCRQRAGAESVRAAMTDPMLRRVRTRRVSTPILVLGATHDGFVSAADVRATARAYRTDPEFFAMGHNMMLEPGWVAVAERIRDWLQAPTAARHR

SEQ ID NO: 4407 - protein, 590 aa, Mycobacterium paratuberculosis
LAASRSNDWGPVSVPVSSLDPRAGNDHSDRSGALRGWQRRALVKYLAGQPRDFLAVATPGSGKTTFALRVAAELLGQRAVEQVTVVVPTEHLKVQWAQAAARHGLALDPRFSNSNPRIAPEYHGVMVTYAQVAAHPTLHRVRTEQRRTLVIFDEIHHGGDAKTWGDAIREAFGDATRRLALTGTPFRSDDSPIPFVRYEAGPDGVRRSQANHTYGYPEALADGVVRPVVFLAYSGEARWRDSAGEEHAARLGEPLSAEQTARAWRTALDPAGEWMPAVIAAADQRLRQLRAHIPDAGGMIIASDRVAARAYATLLTKITSETPTVVLSDDPGSSARISEFAASTSRWLVAVRMVSEGVDVPRLSVGIYATSASTPLFFAQAVGRFVRSRRPGETASIFLPSVPNLLQLASELEAQRNHVLGEPHRVSEGDPLDGDPATRTQNEKSELDNGFTSLGADAELDQVIFDGSSFGTAAPAGSEEEADYLGIPGLLDAEQMRALLHQRQDEQLQRRAGQPSAGDAPPATVHGQLRELRRELNTLVSIAHHRTGKPHGWIHNELRRRCGGPPIAAASREQLRARIDAVRRLNAEHS

SEQ ID NO: 4408 - protein, 814 aa, Mycobacterium paratuberculosis
MTPTGPDPSGHQNACGAVDLAASRRQLLSEGGKLHAAELRHAWLDLHESWLAAKAAQIGIADDSGFALVGIGGLGRHELLPYSDLDLMLLHDNKSDEVLQRVADALWYPLWDANVRLDHSVRTVSGALGVAYGDMIAALGMLDARHVAGDARLSDELIAGARRQWRSAIRSRMDELVEMTQARWDRCGRIAQRAEPDLKSGRGGLRDVQLLDALGVAQLIDRHGMARPESPGGSLDDAHLTLLDVRTELHRVSGRGLDQLLAQYGDELSAALHIGDRFDLARKLSDASRTIAYHAETGLRTAENALPRRGVSALVRRPKRRPLDEGVVEYAGEIVLARDARPDTDVGLVLRVAAASASTGLPIGAATLSRLAAAAPEMPEPWPREALDDLLVLLSAGPTTVTTIEALDRTGLWGRLLPEWDAIRDLPPRDVAHKWTVDRHVIETTVNAAPLATRVARPDLLALGALLHDIGKGRGVDHSVLGAGLALEIGPRLGMAPADVELLAQLVRHHLLLPVAATRSDLNDPKTIERVSKTLGEDPLLLEVLHALTEADSKATGPGVWSDWKASLIDDLVRRCRMVMAGEPLPKVEPAAPQYLSLAADRGVHVQIKPGGGERLDVVMAAPDQRGLVSKAAAVLALNSLRIHSASASTHEGFAVVEFVVSPLFGSPPEAGLLRQQFTGALGGDVDVLGTLEKRDSDAVGAATRRAGEVQVGVPVTRSTAPPRILWVDTAAADQLIVEVRAMDRLGLLALLTRALERAGTDIVWAKVNTFGSTAADAFCVTAGDAGARGAVEQSLLTVLGGPAVEVLEEPVGD

SEQ ID NO: 4409 - protein, 112 aa, Mycobacterium paratuberculosis
MKLITAIVKPFTLDDVKTSLEDAGVLGMTVSEIQGYGRQKGHTEVYRGAEYSVDFVPKVRIEVVVDDSIVDKVVDSIVRAARTGKIGDGKVWVSPVETIVRVRTGERGTDAL

SEQ ID NO: 4410 - protein, 479 aa, Mycobacterium paratuberculosis
LRVTYPILGQPNTGDTAWMLASSALVLLMTPGLAFFYGGMVRARSVLNMLMMSISAMGVVTVLWVLYGYSVAFGDDVGNFMGKPTSYWGLKGLIGVNAVAADPSKGTAATDIPLAGTLPATVFVAFQLMFAIITVALISGAVSDRLKFAAWLVFAGLWATFVYFPVAHWVFAFDGFASEHGGWIANKLHAIDFAGGTAVHINSGVAGLMLAIVLGKRRGWPTTLFRPHNLPFVMLGAGLLWFGWYGFNAGSATSSNGAAGSTFMTTTIATATAMLAWMLTERIRDGKATTLGAASGIVAGLVAITPSCSSVNVLGALVVGLVAGVVCALAVGLKFKLGFDDSLDVVGVHLVGGLAGTLLVGLLAAPESPAISGVTGVSKGLFYGGGWAQLERQAVGAFSVLIYSGVVTLILALILKYTMGLRLNPEAEASGIDEAEHAESGYDFAVATGSVLPPRVAVADTRNGLEEQRVGDKVEAEQS

SEQ ID NO: 4411 - protein, 444 aa, Mycobacterium paratuberculosis
VSQGLWIAVAVLVVIAVLVVITALVLGLARYRRRRISFSTRPEPGAIDRSGGYTASSGITFSQAPTAQPAERLDTTGLPAVGDDATVPRDAPRRTISEVELPEPETPAAPAAEAPAPEAPESPEAPAPEAPAPEIEEIAPTEGRLERLRGRLARSQNALGRSLLGLIGGGDLDEDAWQDVEDTLLVADLGPVVTESVIAQLRGRLASSDVRTEADAKAVLRDVLINELRPDLDRSIRALPHADHPSVLLIVGVNGTGKTTTVGKLARVLVADGRRVVLGAADTFRAAAADQLQTWASRVGAEVVRGAEGADPASVAFDAVDKGIAAGADVVLIDTAGRLHTKVGLMDELDKVKRVVTRCAAVDEVLLVLDATIGQNGLAQARVFAEVVEITGAVLTKLDGTAKGGIVFRVQQELGVPVKLVGLGEGPDDLAPFEPAAFVDALLG

SEQ ID NO: 4412 - protein, 1236 aa, Mycobacterium paratuberculosis
VADVTIVTSASNVRNAARFRAGRHPALRRCGPIWAVVWLAVYLKSLTLKGFKSFASPTTLRFEPGITAVVGPNGSGKSNVVDALAWVMGEQGAKTLRGGKMEDVIFAGTSSRAPLGRAEVTVTIDNSDNALPIEYSEVSITRRMFRDGASEYEINGSSCRLMDVQELLSDSGIGREMHVIVGQGKLDEILQSRPEDRRAFIEEAAGVLKHRKRKEKALRKLDAMSANLARLTDLTTELRRQLKPLGRQAEVARRAQTIQADLRDARLRLAADDLVNRRGEREAIFEAEAAMRREHDEASARLAVASDELAAHEKALGELSGRAESVQQTWFALSALAERVAATVRIASERAQHLDLEPVTTGDTDPDALEAEAERVAAAEQQLLAELATARSRLETARAELAEREREAAEADRAHMAAVRAEADRREGLARLAGQVETMRARVESIDDSVARLSERIEAAAARAQQAKAEFETVQGRVGELDQGEVGLDEHHERTVAALRLADERVAELQAAERDAERKVASLRARIDALAVGLERKDGTAWLTENHSGAGILGPMAKLVKVRSGYEAAVAAVLGSAADALAADGLGAARSALGALKQADGGRAALVLGDWPADPPAPQPAPAGALWALDLIDAPERLRGAITAMLSGVAVVDDLDRALALVAEHPRLRAVTLDGDLVGAGWVSGGSDRKLSTLEVTSEIDKAGAELAAAEAQVAQLSAALSGALAEQAARQDSAEQALAALNESDSAISGMYEQLGRLGQEARTSEDEWSRLLRQREELEAGRTQTVAEVTELENRLRNAQETPQEPAAEPVNRQQIAAATDAARSAEVEARLAVRTAEERANAVRGRADSLRRAAAAEREARVRAQQAREARLRAAAVAAAVADSGRLLATRLNAVVAAASRIRDALAAERQQRATAMAAVRDEVNALSARVAALTDSLHSDEVANAQAALRIEQLEQMVLEQFGMAPADLIAEYGPHIALPPSELEMAEYEQAKERGEQVFAPAPIPFDRPTQERRAKRAERELAELGRVNPLALEEFAALEERYNFLSTQLEDVKAARKDLLGVVDEVDARILQVFSEAYTDVEREFSDVFGVLFPGGEGRLRLTDPSNMLTTGIEVEARPPGKKITRLSLLSGGEKALTAVAMLVAIFRARPSPFYIMDEVEAALDDTNLRRLISLFELLRARSQLIIITHQKPTMEVADALYGVTMQGDGITAVISQRMRGQQVDQLVTT

SEQ ID NO: 4413 - protein, 97 aa, Mycobacterium paratuberculosis
MPEPDARLTAWVHGHVQGVGFRWWTRCRALELGLTGYAANQPDGRVLVVAQGPRPAGEKLLELLRGGTTWPSRPGRVDKVVADWSAPQERFEGFVER

SEQ ID NO: 4414 - protein, 141 aa, Mycobacterium paratuberculosis
MAELWVERTGTRRYTGHSSRGARVLIGSEDVDGVFTPGELLKIALAACSGMASDVPLARRLGDDYRAVIRVSGAADREQERYPLLEETLELDLSGLSDEDRQRLLLVVHRAVDQVCTVGRTLTSGTTVNFEIAAGAGHAGA

SEQ ID NO: 4415 - protein, 258 aa, Mycobacterium paratuberculosis
MATVVAFHAHPDDEVVLTGGTIARAVAAGHRVVVVTATDGRVHNEDTDHRLDELRSSARILGAQRVECLGYADSGYGPLFYPDPPGRTRFGRADLDEAAGKLAGILRDEHADLLLSYQANGGYGHRDHVRVHHVGKRAAELAAVPRVLEVTMPREMLLRISDLAHLLRLPGPYEADIVGSAYAPRAAITHRINVFRFARQKRDAFAAHRSQIGRSGPAARLFGLLLRLPPQVFGALFSHEWFVDPALPTGTVRRDIFD

SEQ ID NO: 4416 - protein, 283 aa, Mycobacterium paratuberculosis
MPELPEVEVVRRGLHAHVVGKTIGAVRVHHPRAVRRHEAGPADLTARLLGARITGTDRRGKYLWLLLDGCDTALVVHLGMSGQMLLGAVPRAEHVRISALLDDGTVLSFADQRTFGGWMLADLLEVDGSILPRPVAHLARDPLDPRFDAAAVVKVLRRKHSEIKRQLLDQQVVSGIGNIYADEALWRAKVHGARIAATMTGRQLTAVLDAAAEVMRDALAQGGTSFDSLYVNVNGESGYFDRSLDAYGREGESCRRCGAVMRREKFMNRSSFYCPKCQPRPRL

SEQ ID NO: 4417 - protein, 237 aa, Mycobacterium paratuberculosis
VSSRQPLLDALGVELPDELLSLALTHRSYAYEHGGLPTNERLEFLGDAVLGLTITDALYHRHPDRTEGDLAKLRASVVNTQALADVARKLCDGGLGAHLLLGRGEANTGGADKSSILADGMESLLGAIYLQHGIDTAREVILRLFGALLDAAPTLGAGLDWKTSLQELTAARGMGAPSYLVTSTGPDHDKEFTAVVVVADTEYGTGVGRSKKEAEQKAAAATWKALDVLDSAAQTSA

SEQ ID NO: 4418 - protein, 209 aa, Mycobacterium paratuberculosis
LELCGRRRRISDMTRQHSTSSVRGAAPRPASPMTFDITRPGRRPGAMVTLRTTVPSPARIGLDMIAIEAGAPLDLDLQVQSVSEGVLVTGSVTGPTVGECARCLTALDGEVRVRLTELFAYPDSTTEATTEEDEVGHIVDDTVDLEQSIIDAVGLELPFSPVCRPDCPGLCPECGVSLAAEPGHQHDRIDPRWAKLAGMFASDEARDER

SEQ ID NO: 4419 - protein, 245 aa, Mycobacterium paratuberculosis
VYRVFEALDELSAIVEEARGVPMTAGCVVPRGDVLELIDDIKDAIPGELDDAQDVLDARDSMLSDAKTHAESMVSSATTESESMLNHARAEADRVLSDAKAQADRMVSEARQHSERMVAEAREEALRIATAAKREYEASVSRAQAEADRLLENGNISYEKAVQEGIKEQQRLVSQNSVVEAAHAEATRLIDSAHAEADRLRGECDIYVDNKLAEFEEFLNGTLRSVGRGRHQLRTAAGTHDYAVR

SEQ ID NO: 4420 - protein, 268 aa, Mycobacterium paratuberculosis
VRGDVPASAAVLVAAIRIAHLRLGFGRSTPNRIAVSYGLLTVSWLALTATNADGPGRMAVKGLVAAFLAVTGVRGWLVARRVERRIILLQDASQRFPGAAAALRAAPRTEPASPRWRPTVALLTAVVLVTTGALAAVYLAHRQSPDCRTANDMARFVASHPDMLDPAFISANSGGPTLADYQLWSEQLDRYAASSGGDVAPGLRSAAALSARATAVVREARADPADWQDPRQQRRRNDYAIIAGQLVTEVRALESHCPPRSSLLTRRT

SEQ ID NO: 4421 - protein, 387 aa, Mycobacterium paratuberculosis
MTTVLSAVGHALAVAGSMTWEILWALILGFALSAVVQAVVRRTTIVALMGDARPRTLAVSAGLGAASSSCSYAAVALARALFRKGADFTAAMAFEIGSTNLVVELGIILTLLMGWQFTAAEFVGGPLMIVVLALLFRLFVRPRLVDAARAQAQRGIAGSMEGHAAMDMSVAGDGPFWRRLLSAAGFTAVSHVFVMEWLAILRDLVLGLLIAGAVAAWVPEKFWQSFFLVDHPGWSVLWGPIVGPLVAIVSFVCSIGNVPLAAVLWNGGISFGGVIAFIYADLLILPILNIYRKYYGTRMMLTLLGTFYAAMVAAGYLVELIFGTSGLIPAQRAATVAEASVSWNYTTWLNVAFLVLALVLIVRFVRTNGLAMVRMMGGSPDPAEHRH

SEQ ID NO: 4422 - protein, 569 aa, Mycobacterium paratuberculosis
MTLDNPLDGPEAAADLIALLADEGVADFFINPGTDSAPIQEALAAARAAGTPSPRAVLCVHESVALAAAIGHHMASARPQAVMVHVDAGTLNLGCQLHNAQRNGTPVVVFAGRTPYSSAPDVRGHRDTHIHWQQEQLDQPAVMRNYAKWHMEVPRGRELAPIVRRAFQVAQSSPPGPAYVMLPREALMEPGGRALQRRLPPAVPPGPDPAALGRLAGILVAGQRVVIVTARTAADPAAATVLARIAEILGAPVIDQGDRANLPPGHPLHVTGDAAPLQDADTVLLLDSEVPWVPAQLAPPATARVVQIDADPVKPSMPLWSYPVEIALTADTRVALLLLEQTLLRLANDELREKWSTRRGAVESQVAQRRREAARRAESDSDADAPDAMLAALGGALPDDAVVVQEAVTNRPAVARQVRRPPGQLFDTGAPALGWALGGAFGIKLARPHAPVVAICGDGSFNFGVPTAALWSAHRYGAPFVTVVLNNHSYLASKTPVTELYPQGISVRDNDFPETRLTPETDYAALARACGGSGRDVHTPAQMREAIGWALDEAGQGRCAVLDVRLPQT

SEQ ID NO: 4423 - protein, 427 aa, Mycobacterium paratuberculosis
RPKLVGPRCHDVVMSSSVLAAEVEVRPCDRLAVLFDELAELTGQRNAIDGRIVEIVAQIEREQLWGATGARSLGALVAWKTGCSPGNAETIAAVARRLDSFPRCAAGLREGRLSLDQLGVIAQRAGAGSDAHYAQLATVATVNQLRTAVKLEPRPQPEAKPAPQPGLTKTSDEELSCWRIKLDRLDAATFDAALAAHREALISEWKRDHNHRAGESVPPLPGTLEAFIRLIETGWDAEAHRRPHGHHTTVVVHLDAAQRIAGLHLGPLLSDAERRYLTCDATCEVWVERDGQPIGAGRSTRVINRRLRRALEHRHRGCAIPGCGATRGLHAHHLRHWEDGGPTELSNLVLVCPYHHRAHHRGEITITGPADTLLVTDSSGRHLKPGSLARKPTRPPPAVPPCPGPLGQRADWWWYDPFQPQPPPTTN

SEQ ID NO: 4424 - protein, 160 aa, Mycobacterium paratuberculosis
MTGAVCPGSFDPVTLGHVDVFERASAQFDEVVVAILTNPAKKGMFDLDERIAMIEESTTHLSNLRVEAGQGLVVDFVRSRGMTAIVKGLRTGTDFEYELQMAQMNKHIAGVDTFFVATAPRYSFVSSSLAKEVAMLGGDVSELLPEPVNRRLREKLSGRS

SEQ ID NO: 4425 - protein, 184 aa, Mycobacterium paratuberculosis
MTRIIGGVAGGRRLAVPPRGTRPTTDRVRESLFNILAARRELTGLAVLDLYAGSGALGLEALSRGAATALFVESDPRAAAVIARNIDTLGLPGATLRRGAVAAVLAGGAATAVDLVLADPPYDVGAAEIDAVLAALAAHGWVRAGSVAVVERPAGSAPLSWPPGWSGWPHRVYGDTRLELAERL

SEQ ID NO: 4426 - protein, 211 aa, Mycobacterium paratuberculosis
VTGAVATEATGLTPDSPAGPAVPALSAWSVLVAGVIGLVASVTLTLEKIDILLDPAYVPSCNINPILSCGSVMITPQASLLGFPNPLLGLVAFTVVVVTGLLAVTKVVLPQWYWIGLAAGLVVGAVFVHWLIFQSLYRIGALCPYCMVVWVVTIALLVVVASIAYRPALGDRRSGPGWLLFQWRWSIVALWFTAVFLLIMVRFWDYWSTLL

SEQ ID NO: 4427 - protein, 255 aa, Mycobacterium paratuberculosis
VADNPKRPPRFDMKSASGGKSGRLVQIGGTAFVVIFAVALVFYIVTSHHKKAGPTGAGDTVRVTSSKLITQPGSSNPKAVVTLYEDFLCPACGNFERTFGPTVSKLIDLGAIAADYSMVSILDSPRNQNYSSRAGAAALCVADESLDAFRRFHTALFSTAIQPSETGKTFPDNARLIELARESGVVGKVPDCINSGKYIAKVTGEAAAAKIRATPTIKINGEDYDPSTPDALVGKIKEIVGDIPGLDGAVAPAAM

SEQ ID NO: 4428 - protein, 373 aa, Mycobacterium paratuberculosis
MTKPLTDTAPVDPGAQRGSMPLTNRIQGAVTSVGVKVIPWIPTAVRRGLVRGRSVIIDGNTLDPTLQLMLSGLRAVGIDGLVVDDDPELSRAQMHESTVGFPGPQIHVDVAELALPGPAGDIPARHYRPAGGETQAPLLVFYHGGGWSIGDLDTHDSLCRLTCRDAGIHVLSIDYRLAPEHPAPAAIDDAYAAFTWAHEHAGELGAIPGRVAVGGDSAGGNLAAVVSQLARDAGGPAPVLQWLIYPRTDFTARTRSLSLFSRGFLLTKRDIDWFESQYLRNSRLDRTDPRVSPALAESLAGLAPALIAVAGFDPLRDEGQSYAEALRAAGTPVDLRYLGSLTHGFANLFQLGGDSMVATSELISALRAHLSRV

SEQ ID NO: 4429 - protein, 281 aa, Mycobacterium paratuberculosis
LTGESGSAAPSIALNDENTMPVLGLGVAELSDDETERAVSAALEVGCRLIDTAAAYGNEAAVGRAIAASGIPRAELFVTTKLATSDQGFKGAMDACEASLERLGLDYVDLYLIHWPAPALGTYVNSFGGMIQSRGNGHARSIGVSNFTEEYLTTVIDLTFVTPAVNQIELHPLLNQEALRKTNAEHNVVTQSYTPLALGKLNDHPTVNSVAAEYGKTASQVLLRWNLQLSNAVIFRSANAEHIASDFDVFDFELAAEHMDAINALNDGTRLRPDPDTYEGS

SEQ ID NO: 4430 - protein, 238 aa, Mycobacterium paratuberculosis
MNVNRKVLLWLAAAAALAVLVAYQAVGSSTRHTAEYAARADVPTVQPGTDVLAGIAVLPVRQHRYDYLRSAFGDAWDDDNDAPMGHNGCDTRDDILNRDLVDKTYVSVKRCPDAVATGTLHDPYTNKTIAFQRGPKVGESVQIDHIVPLAYAWDMGAYAWPGPERRRFANDPANLLAVDGQANQDKGDAAPAQWMPPNAAFHCQYAMQFIAVLRGYALPVDQASTGVLRQAAATCPAG

SEQ ID NO: 4431 - protein, 738 aa, Mycobacterium paratuberculosis
MASLTDRLDFVVGAKAAEQLEELFGIRTVDDLLRHYPRSYTEGASRWGADDERPPAGEHITIIDTITETKTWPMKKTPKKVCHRITLGAGRNKVTATFFNANYLKKGLTEGTKVMLSGEVGFFKNVMQLTHPAFLILDSPDGRNKGTRSLKNIANASGASGEAVLDAYERHFFPIYPASTKMQSWDIFSCVRLVLDVLDPVPDPLPEPLRAKFDLVCEDQALRDIHLAENEARRQRARERLTFDEAVGLQWALVARRHGELSESGPPAPPRPDGLAAELLRRLPFELTAGQREVLDVLSDGLASTRPLNRLLQGEVGSGKTIVSVLAMLQMVDAGYQCALLAPTEVLAAQHLRSIRDVLGPLAMAGQLGGADNATRLALLSGSMTAAQKKQVRDEVAGGQVGIVVGTHALLQDAVEFHNLGMVVVDEQHRFGVEQRDRLRAKARPGVTPHLLVMTATPIPRTVALTVYGDLETSTLRELPRGRQPITSNVIFVKDKPAWLGRAWRRIGEEVAAGRQAYVVAARIDESDDDGAADQNAKAPETAEGLYARLRSQELAQLRLGLMHGRLSAEEKDAVMAAFRAGDIDVLVCTTVIEVGVDVPNATVMLVMDADRFGISQLHQLRGRIGRGEHPSLCLFASWAAPDSPAGRRLTAVAETMDGFALADLDLKERREGDVLGRNQSGRAVTLRLLSLADHQEYIEAARDFCVQAYAGNRFDPGLSLLAARFTDTDRIEYLDKS

SEQ ID NO: 4432 - protein, 575 aa, Mycobacterium paratuberculosis
VAAQRRWVTLGSSWTSHDRPLDAAALRDWAHTAVSDLITHIDEINRLNVFPVADSDTGANMLFTMRSALAELQAAGGPGCVARAAAALSTGALNGARGNSGVILSQILRGVADVTATAAARAGGELARIEAAVLGAALQRGVELVITSMGGEEIPGTIVSVLRAAATAVAQCARAGEGVTAAVIAAGDAAVIALEKTPEQLDVLADAGAVDAGGRGLLVLLDALRTTITGQAPARTVYRLAPRTAAPEAAAPRPAPQFEVMYRLDDCAPAAADALRDRLTELGDSVGIASAPSSAQHTYSVHVHTDDAGAAVEAGLAAGRLSRIVISALSSGGPGLPAGGWTRERAVLAVVDGDGAAGLFSGEGACVLQRDPAAADPVTTISAHQLMRAVVDTGAAQVMVLPNGYVAAEELVAGCTAAIGWGIDVVPIPTESMVQGLAALAVHDTGRQAVDDGYTMARAAGAARHGSVRIATETALTWAGSCRPGDGLGIAGGEVLIVAADAVGAAIGLLDLLLASGGDLVTVLLGAGIDADGSDAHAGAVVDILEEHMHDHHPGTELVTYRTGHHGDVLLIGVE

SEQ ID NO: 4433 - protein, 256 aa, Mycobacterium paratuberculosis
VRGVVARAENTAGPARAETRRGSPVDVRRWVLRLRRMATAYAVVAALGSLAIGSESVNCPTAVGGQSDIGQGGPGPRASRAPRAAPTWWWPPAEPRPAVHEVAAVRGGIQLRQVAFDGRGAWADGPEAIRGYLEEALTRIGVTDASARGRWIDGMMTIADHESQFHSAAINLADSNAYGPAQLDGGPLHATRGPWQLMPDTFAAFHQPGTSNSAWDPVAAACASMNYQMSRYGVSPDGSNQRLLVGQANPGIRQGY

SEQ ID NO: 4434 - protein, 273 aa, Mycobacterium paratuberculosis
MGEFDNTVAVVTGAARGQGRSHAVALAQQGADVIVVDICADLPAIPYALGTEAELAETVRLVESAGRAAVPVIADVRDLQALRAGVQAGIDRLGDIDVVVANAGVVAIGVTEAESEPVFNTIVDTNLKGVWHTMLATVPSIVRKGRGGSVVLVSSSQGLTGRGGDGSAAMFAYAASKHGVVGLMRSAANAYAPHKIRVNSVHPSGVATPMILNDFVVNRMLENPNPALSQTLLPEVPLVESRDVTGAVLWLAGPRSRYVTGVAIPVDAGHVVM

SEQ ID NO: 4435 - protein, 296 aa, Mycobacterium paratuberculosis
VTIPWTPDRLGDLTGRRVIVTGATNGVGLGTARALAKAGAEVILAVRNTELGKQRAAQMGGSTAVEKLDLADLSSVRAFADRIEAPVDILINNAGALTDRRTETVDGFEMTLGTNLLGPFALTNLLLPKVRSQIINVGSDAHRSATLHLDDLHLRRHKWTRLGAYAQSKLAVMLWGLELDRRLRAAGSPIVTQLTHPGWVASNLSNLGDAPLKAVAHKAVKVVADRLANDIDEGAAPTLYCISEPIPPGSYVGVSGRFGLRGGPVLIGRTPLACDYDTAARLVAFAERETGTELRV

SEQ ID NO: 4436 - protein, 600 aa, Mycobacterium paratuberculosis
QRHRDHQPHLHLRAAARRRRPGRGGPALRTRPHLRRAGRPAGNGVRRLGPGAPDVRDGHPHLRGRHPEDQTQHHQRAARHRRGAGHRAQHLLLLRHPGHARAAAAGHRHRALPGHVPPGERRLVLREPDHVRRPGRRRQPPSEVLTRVDPFDPDAVLADYGLRPEQVNELLPCTASVLVNILEEQPMPEHPVATRSQHEQELAALDLIEHPTVRAAYRSVAQTWLGRADASDAMRARFDDAFAEVMFSAAIWSSNQDKLRPKVSCITRLAHPVDGRRVPGSRWGIDNPDSVYRVIPISGEERYEIHGWVGEHRMTENYFTLWDARMGTIDVLNGRTMRVEPDGSFTITVDAQPANGRPNHVRTSAAAHEFYIRDVLLDRDRDDPNYFEVQRLGGPPATPARTLDEQAEATAAMMAYFADFTGKLSHGVYKMPANRFDLAWSAEKAGAMRNQVYVMGRFDLAPDEAFVVEVNDGGAEYFTVPLSNIWGTTLDIVDRTGSLNKAQSVANEDGSYTYVIAPTDPGVANWIDSDGLREAILTLRMAEFGEHGPREDLGARGRVVKLDRLDTEVAHLPRVSPQQRAAELAQRRAGYLRRLPEGTI

SEQ ID NO: 4437 - protein, 276 aa, Mycobacterium paratuberculosis
MARWLITGCSTGFGREIAGAALQAGHRVVVTARRADAVRGFAEEFGELALPVALDVTDRDQIAAAVAAADAAFGGIDVLVNNAGHGYLSAVEEGEDAEVRKLFDVNYFGAVDMIKAVLPGMRARGCGHIVNISSMTGLVANPPNAYYSSTKFALEAVTEALAAEVRPLGIKVTAIEPGAFRTDWATRSMKESGTPIADYTDVAARKDLIKQFADHLPGDPRKVAEAVLMVTGLDEPPLRLLLGRDVLKAMRDKIAAMSASIDEWEAVTKDVNFPGA

SEQ ID NO: 4438 - protein, 227 aa, Mycobacterium paratuberculosis
MTARPLNELVEPGWARALQPVAEQVARMGQFLRAEIAAGRRYLPAGPNVLRAFTYPFDEVKVLIVGQDPYPTPGHAVGLSFSVAPDVSPLPRSLANIFQEYTADLGHPPPSCGDLTPWAQRGVLLLNRVLTVRPSNPASHRGKGWEPVTECAIRALTARQQPLVAILWGRDASTLKPILAQGNCVAIESPHPSPLSASRGFFGSRPFSRANKLLAEMGADEIDWRLP

SEQ ID NO: 4439 - protein, 341 aa, Mycobacterium paratuberculosis
LSVGPLLPGFPVLAVGPPGRQPYGGGVRDESTLRQLGEFAVIDRLVAGRRQPAAVTLGPGDDAALVTTGDGRVVVSTDMLVQDRHFRLDWSTPHDIGRKAIAQNAADIEAMGARPTAFVVGFGAPGQTAAAQVDALVDGMWDEAQRVGAGIAGGDLVSCPQWVISVTALGELDGRSPVRRAGAEPGSLIAVAGDLGRSAAGFDLWRNQIGGFDELRRRHAVPQPPYGQGAVAAAGGAQAMIDVSDGLIADLRHVAEASGVGMDVSTAALAADRDAVAAAATAVGVDAWPWVLTGGEDHALVACFPGPAPAGWRIIGRVLDGPARVLVDEREWSGPAGWQSY

SEQ ID NO: 4440 - protein, 187 aa, Mycobacterium paratuberculosis
VATESEADGGPPRAVIMVAVALAVTTIGVILAIAATREAPPQPVAVAAFPAPHAGDAACRALLDALPQRLGDYQRAPLEQPAPAGAAAWRTGPDSEPVVLRCGLDRPAEFVAGSPIQVVDRVQWFAVRPDPQSAGDAGRSTWYTVDRPVYVALTLPSGSGPAPIQRLSDVIGQRIAAAPVNPGPPAG

SEQ ID NO: 4441 - protein, 373 aa, Mycobacterium paratuberculosis
PVQIVNASQRVRVAVVFGGRSNEHAISCVSAGSILRNLDPRRFEVVAIGITPQGSWVLTDGDPAALAISDRQLPEVTSASGTELALPADPGRSGQLVSLPPGASEVLASVDVVFPVLHGPYGEDGTIQGLLELAGVPYVGAGVFASAAGMDKEFTKKLFAAEGLPIGDYAVLRPSQSTLSLQDRERLGLPVFVKPARGGSSIGVSRVSSWDELDAAVAAARDHDPKVIVEAAIAGRELECGVLEMPDGTVQASTVGEIRVAGVRGREDSFYDFATKYLDDTAELDVPAKVDDEIADAVRELAIRAFKAVDCQGLARVDFFLTETGPVLNEINTMPGFTTISMYPRMWAASGVDYPSLLATMVETALARGVGLR

SEQ ID NO: 4442 - protein, 333 aa, Mycobacterium paratuberculosis
MGAGAWGTALAKVLVDAGGPGTEVTLWARRPELAERINATRSNPDYLPGTSLPPGIHATADAGEALRDATTVLLGVPAQAMRANLERWAPLLRDGATLVSLAKGIELGTLMRMSQVIVSVTGVDPAQVAVISGPNLASEIAACQPAATVVACSDSGRAVALQRMLNSGYFRPYTNSDVVGTEIGGACKNVIALACGMAAGVGLGENTAAAIITRGLAEIMRLGIALGAKGATLAGLAGVGDLVATCSSPHSRNRSLGERLGRGATIGSVLAGSPDGGDGHVVEGVTSCQSVLALAASYDVEMPLTDAVHRVCHKGLSVDEAMALLLGRRTKPE

SEQ ID NO: 4443 - protein, 160 aa, Mycobacterium paratuberculosis
SLGSITVITPDEAAAAAAAGLGADVLADPTPEGHPDPLNNAIATAERAVSGSFTNIVALQGDLPALQSQELAEAVAAARAHRRSFVADRLATGTAALFAFGTRLDPRFGSDSSARHRSSGAIELTGAWPGLRCDVDTPTDLAAARRLGVGAATARAIAAH

SEQ ID NO: 4444 - protein, 730 aa, Mycobacterium paratuberculosis
VMRHDRNVTEIDAETRPDENLWHSGDSAVGAPPAATPAAMTDLPEDRYLNRELSWLDFNARVLALADDNSLPLLERAKFLAIFASNLDEFYMVRVAGLKRRDEMGLSVRSADGLTPRKQLALIGEHTQRIATRHARVFLDSVRPALAEEGIHIVTWADLDQAERDELSTYFTEQVFPVLTPLAVDPAHPFPFVSGLSLNLAVMVRQTEDGGQHFARVKVPNNVDRFVELAAPRAGAEGENRGVVRFLPMEELIAAFLPLLFPGMEIVEHHAFRITRNADMEVEEDRDEDLLQALERELARRRFGPPVRLEIADDMTEGMLELLLRELDVHPGDVIEVPGLLDLSSLWQIYDLDRPALKDPAFVPDTHPAFADRESPKSIFATLREGDVLVHHPYDSFSTSVQRFIQQAAADPNVLAIKQTLYRTSGDSPIVRALIEAAEAGKQAVALVEIKARFDEQANIRWARALEQAGVHVVYGLVGLKTHCKTCLVVRREGSAIRRYCHIGTGNYNSKTARLYEDVGLLTAAPDIGADLTDLFNSLTGYSRKVSYRNLLVAPHGIRTGIIERVEREIAAHRERGQGRIRLKMNALVDEQVINSLYRASQAGVRVEVVVRGICALRPGVQGYSENIFVRSILGRFLEHSRIIHFRNINEFWIGSADMMHRNLDRRVEVLAQVKDPKLTAQLDELFESALDPSTRCWELGPDGQWTPSPQEGHTVRDHQVSLMERHRSP

SEQ ID NO: 4445 - protein, 315 aa, Mycobacterium paratuberculosis
VPTQNSSTARRAGTRVVYAAGAVLWRPGDAEPDGGDVEVAIIHRPRYDDWSLPKGKVDPGETAPVAAVREVREETGQCAVLGRRLDTVRYPIEQGVKKVYYWSARATGGEFVPGDEVDQLLWLPVAEAMQRLNYTQDRKVLRHFNKKPADTHTVLVVRHGTAGRKSRFSGDDAKRPLDKRGRAQAEALVPQLLAFGASQVHAADRVRCHQTVQPLAEELDVPVHNETTLTEEAYAKNPKRARHRMLEIAGEPGTPVVCTQGKVIPDLIAWWCDRDGVRPDKSRNHKGSTWVLSLSAGRLVAADHIGGALAANVRA

SEQ ID NO: 4446 - protein, 212 aa, Mycobacterium paratuberculosis
MNKAELIDVLTQKLNTDRRQATAAVENVVDTIVRAVHKGDSVTITGFGVFEQRRRAARVARNPRTGETVKVKPTSVPAFRPGAQFKAVVSGAQRLPSEGPAVKRGVVGGAAKKTAAKKAPAKKAAAKKAPAKKAAAKKAPAKKAAVKKAPARKAATKAPVRKAATKAPAKKVAAKKAPAKKAATKAPAKKAASKAPARKAAAKKTTARRGRK

SEQ ID NO: 4447 - protein, 200 aa, Mycobacterium paratuberculosis
MSMEAFHTHTGIGVPLRRSNVDTDQIIPAVYLKRVTRTGFEDGLFASWRSDPSFVLNLSPFDRGSVLVAGPDFGTGSSREHAVWALMDYGFRVVISSRFGDIFRGNAGKAGLLAAEVSQDGVELLWKLIEQSPGLEITANLQDRNITAGTTVLPFKIDDHTAWRLLEGLDDIALTLRKLDRIESYEATYPDWKPRTSPVA

SEQ ID NO: 4448 - protein, 476 aa, Mycobacterium paratuberculosis
MGIDTGTTATPRTLAEKVWDDHVVVSGGANEPDLIYIDLHLVHEVTSPQAFDGLRLAGRPVRRPDLTLATEDHNVPTVDIDKPIADPVSRTQVETLRRNCAEFGVRLYPMGDAEQGIVHVVGPQLGLTQPGMTVVCGDSHTSTHGAFGALAMGIGTSEVEHVLATQTLPLRPFKTMAVNVDGELPAGVTAKDIILALIAKIGTGGGQGHVIEYRGSAIESLSMEGRMTVCNMSIEAGARAGMIAPDDTTYEFLRDRPHAPKGAQWDAAMRYWQQLRTDPGAVFDTEVYLDAASLSPFVTWGTNPGQGVPLAAAVPDPELMTDDAERQAAEKALAYMDLRPGTPMRDIAVDAVFVGSCTNGRIEDLRVVADVLRGRKVAPGVRMLVVPGSMRVRAQAEAEGLGEVFTAAGAEWRQAGCSMCLGMNPDQLAPGERCAATSNRNFEGRQGKGGRTHLVSPAVAAATAVRGTLSAPADLD

SEQ ID NO: 4449 - protein, 233 aa, Mycobacterium paratuberculosis
VRQHSGIGVLDKAVGVLHTVAQSPCGLAELCERTELPRATAYRLAAALEVHRLLARGDDGRWRLGPAVTELAAHVNDPLLAAGSAVLPLLRETTGESVQLYRREGTDRVCVAALEPAAGLRDTVPVGARLPMTAGSGAKVLLAHSDAATQKAVLANAKFTERTLAEVRRRGWAQSVAEREPGVASVSAPVRDSRGAVIAAISVSGPIDRIGRRPGARWAADLVSAAEALTRRL

SEQ ID NO: 4450 - protein, 170 aa, Mycobacterium paratuberculosis
MGTNQRASIVMSDDEIADFVVKSRTGTLATIGRDGQPHLTAMWYAVVDGEIWLETKAKSQKAINLKRDPRVSFLIEDGDTYDTLRGVSFEGVAELVDDPDVAHRVGVSVFERYTGPYTDEMKPFVEQMMNKRVCVRIVARRARSWDHRKLGLPPMPVGGSTAPAVLGTDR

SEQ ID NO: 4451 - protein, 492 aa, Mycobacterium paratuberculosis
VTAPANVRVRFCPSPTGTPHVGMVRTALFNWAYARHTGGTFVFRIEDTDAARDSEESYLALLDALRWLGLDWDEGPEVGGPYGPYRQSQRGEIYRDVVAKLVEAGEAYYAFSTPEEVEARHIAAGRNPKLGYDNFDRHLTDSQRAAFLAEGRQPVVRLRMPDEDLGWDDLVRGSTVFAAGSVPDFALTRANGDPLYTLVNPCDDALMKITHVLRGEDLLPSTPRQLALYQALIRIGVAERIPQFAHLPTVLGEGTKKLSKRDPQSNLFAHRDRGFIPEGLLNYLALLGWAIADDRDVFSLDEMVAAFDVVDVNSNPARFDQKKADALNAEHIRMLTAADFAARLRHYLDVHGHRLALDDAAFATAAELVQTRIVVLGDAWDLLKFLNDDEYAIDPKAAAKELGPDGAAVLDAALPALDAVTDWAAPQIEAALKTALIDGLGLKPRKAFGPIRVGATGTTISPPLFESLQLLGRDRSLRRLRAARERAGQHSA

SEQ ID NO: 4452 - protein, 242 aa, Mycobacterium paratuberculosis
MIAREIAEHPFGTPNFTGRSWPLADVRLLAPILASKVVCVGKNYADHIAEMGEATGPVPADPVIFLKPNTAIIGPNVPIRLPANASPVHFEGELAVVIGRPCKDVSAAQAAENILGYTIGNDVSARDQQRSDGQWTRAKGHDTFCPVGPWIVTDLNPLDPGDLELRTEVNGEVKQRSRTSLLIHDIGSIVEWISAVMTLLPGDLILTGTPAGVGPIEDGDTVSITIEGIGTLTNPVVRKGKS

SEQ ID NO: 4453 - protein, 434 aa, Mycobacterium paratuberculosis
MQTDPVATPDVGAGTRWSIMVVSLLATASSFLFINGVAFLIPSLQGARGIRLDEAGLLASMPSWGMVVTLVAWGYVLDRVGERVVMTTGSALTALAAYAASSAHSMVLIAAYLFLGGMAAASCNTAGGRLVSAWFPPHQRGLAMGIRQTAQPLGIALGAMVIPELAEHGPQAGLRFTALACVFGAVASVIGIVDPPRKPRASASDQELASPYRGSLTLWRIHAVAGLMMMPQTVTVTFMLVWLIRNLHWSVAAAGALVTLSQLLGALGRVAVGRWSDRLGSRMRPVRYIAAAAVLVLLLLAWADYLNSRWQAGLMVAISVIAVLDNGLEATAITEFAGPYWSGRALGIQNTTQRMMAAAGPPLFGALISAAKYPPAWLLCALFPLAAMPLVPTQLLPPGLETRARRQSVRRLRWWRAVRSHALPDIVRRPGQPG

SEQ ID NO: 4454 - protein, 336 aa, Mycobacterium paratuberculosis
MKLAVIGGDGIGPEVTAEALKVLDAVLPGVDKTEYDLGARRYHATGELLPDSVIDELRAHDAILLGAIGDPSVPSGVLERGLLLRLRFELDHHINLRPGRLYPGVSSPLAGNPDIDFVVVREGTEGPYTGTGGAIRVGTPNEVATEVSQNTAFGVRRVVVDAFERARRRRKHLTLVHKTNVLTFAGKLWSRIVAEVGRDYPDVEVAYQHIDAATIFMVTDPGRFDVIVTDNLFGDIITDLSAAVCGGIGLAASGNIDGTRTNPSMFEPVHGSAPDIAGQGIADPTAAIMSVALLLAHLGEDAAATRVDRAVERYLATRGNERPATTEVGERIAAAL

SEQ ID NO: 4455 - protein, 528 aa, Mycobacterium paratuberculosis
VNLPVVLIADKLAESTVAALGDQVEVRWVDGPDREKLLAAVPEADALLVRSATTVDAEVLAAAPKLKIVARAGVGLDNVDVDAATERGVLVVNAPTSNIHSAAEHALALLLAAAREIPAADASLREHTWKRSSFSGTEIFGKTVGVVGLGRIGQLVAQRLSAFGTHLIAYDPYVSPARAAQLGIELLSLDELLARADFISVHLPKTPETAGLIDKDALAKTKPGVIIVNAARGGLVDEAALADAVRSGHVRAAGLDVFSKEPCTDSPLFELPQVVVTPHLGASTTEAQDRAGTDVAASVKLALAGEFVPDAVNVAGGTVNEEVAPWLDLVRKLGLLAATLSDGPPVSLSVQVRGELASEDVEVLKLSALRVLFSAVVEGPVTFVNAPALAEERGVTAEISTASESPNHRSVVDVRAVSHDGTAVNVAGTLSGPQLVEKIVQINGRNFDLRARGINLVINYVDQPGALGKIGTLLGSAGVNIQAAQLSEDAEGPGATILLRLDQDVPADVRSAIGAAVGANKLEVVDLS

SEQ ID NO: 4456 - protein, 475 aa, Mycobacterium paratuberculosis
VDVTIVGSGPNGLTAALICARAGLKVQVVEAQPTFGGGARTAADPDSAGVLHDICSAVHPLALASPFFAEFDLPARGVQLAVPEISYANPLPGRPAAIAYRDLDRTCAELEHGASFRRLLGPLVARSDDVVALLLGDKRSLPNSPTSALRLGLRMLAQGTPAWGTLAGEDARALFTGVAAHIISRMPSLTAAGAGLMLATLAHSVGWPIPVGGSQAITDALIADLRAHGGELTAGAEVTEPPGGVVAYDTAPTALLRIYGDALPPRYAKALRRYTFGPGVAKVDFVLSDEIPWSDPRLRQAPTLHLGGTREQMARAEADIAAGRHAQWPMVLAASPHVADPGRIDAAGRRPFWTYAHVPAGSTLDATEAVTAVVERFAPGFRDVVVAARAIPAARLCDHNANYVGGDIGIGGNSAWRAIAGPTPRVNPWSTPIPKVYLCSAATPPGGGVHGMAGYYAARTLLRREFGLGMPRLAP

SEQ ID NO: 4457 - protein, 199 aa, Mycobacterium paratuberculosis
MTKLAIIYYSATGHGTTMARRVAAAAESAGAQVRLRHVAETQDPESFAHNPAWTANYQATKDLPAATGDDIVWADAVIFGSPTRFGSPAAQLRAFLDSLGGLWAQGKLADKVYAAFTSSNTLHGGQETTLLSLYITLMHFGGIIVAPGYTDPSKFVDGNPYGASLVTTHDNIHEFDEPTANALDHLARRVVETAGRLAS

SEQ ID NO: 4458 - protein, 343 aa, Mycobacterium paratuberculosis
VANPSGETLPMFYDDDADLTIIQGRKVGVIGYGSQGHAHSLSLRDSGVQVKVGLKEGSKSRAKVSEQGLDVDTPAAVAKWADVIMLLAPDTAQADIFKNDIEPNLSDGDALFFGHGLNIHFGLIKPPAEVTVAMVAPKGPGHLVRRQFVDGKGVPCLIAVDQDPTGKGEALALSYAKAIGGTRAGVIKTTFKDETETDLFGEQAVLCGGTEELVKAGFDVMVEAGYPPEMAYFEVLHELKLIVDLMYEGGIARMNYSVSDTAEFGGYLSGPRVIDAGTKDRMREILRDIQNGDFVKKLVANVEGGNKQLEQLRKENAEHPIEVVGKRLRDLMSWVDRPITETA

SEQ ID NO: 4459 - protein, 168 aa, Mycobacterium paratuberculosis
MSPQTHTLSVLVEDKPGVLARVAALFSRRGFNIESLAVGATEQKDMSRMTIVVSAEETPLEQITKQLNKLINVIKIVELEDGNSVSRELALIKVRADAGTRSQVIEAVNLFRAKVIDVSPEALTIEATGDRGKIEALLRVLEPFGIREIVQSGVVSLSRGPRGIGTAK

SEQ ID NO: 4460 - protein, 622 aa, Mycobacterium paratuberculosis
VSAPTRRPAPDAPGAAGIAPAPPAPAAKPAAGKPKRIGPEQVTGAQSVIRSLEELGVEVIFGIPGGAVLPVYDPLFDSKKLRHVLVRHEQGAGHAASGYAHATGKVGVCMATSGPGATNLVTALADAQMDSIPVVAVTGQVGRTLIGTDAFQEADISGITMPITKHNFLVRSGNEIPQVLAEAFHIAASGRPGAVLVDIPKDVLQGQCTFSWPPRIHLPGYKPTTKPHSRQIREAAKLIAAARKPVLYVGGGVIRGEASEQLRELAELTGIPVVTTLMARGAFPDSHRQHLGMPGMHGTVAAVAALQRSDLLIALGTRFDDRVTGKLDTFAPEAKVIHADIDPAEIGKNRHADVPIVGDVKAVIAELVEMLRHDGAPGNLDIADWWAYLDDVQSTYPLSYGPQSDGSLGPEYVIEKLGQIAGPDAVYVAGVGQHQMWAAQFISYEKPRTWLNSGGLGTMGFAIPAAMGAKMARPEAEVWAIDGDGCFQMTNQELATCAVEGIPIKVALINNGNLGMVRQWQTLFYEERYSQTDLATHSHRIPDFVKLAEALGCVGLRCEREEDVVDVINAARAINDRPVVIDFIVGADAQVWPMVAAGTSNDEIQAARGIRPLFDDETEGHA

SEQ ID NO: 4461 - protein, 152 aa, Mycobacterium paratuberculosis
LGTRPALARVSSGSVANVTAGRRSSSPLFRRARAQEPRWKRSPSMSSQRTVRLSSSVRTVTPRSSATVRNRTISAESSTGSSSNGADGGQSITGISRPKVKNPTARCATGDTLITTGAAAGGGDGTGDDEPLATRPSFHPDQRGAHGHGFDC

SEQ ID NO: 4462 - protein, 286 aa, Mycobacterium paratuberculosis
VTSQPNDAHWQRPGESPEPTPGRPASARLVDPEDDLTPVGYPGDFNPSTGTTTVIPYGGAAAVAGSGAAGYHLLEQQEPLPYVQPHSAARHAAPEPTDVDDDEHHDRLLDVGRRGTQHLGLLVLRAGLGVVLGAHGLQKLFGWWGGSGVTGLRNSLSDVGYQHADILAYVSAGGELVAGVLLVLGLFTPLAAAGALAFLINGLLATVSARPHAHTFSFFLPQGHEYQITLIVMATAVILCGPGRYGLDARRGWAHRPFIGSFVALLAGIAAGVGVWVALNGVNPIG

SEQ ID NO: 4463 - protein, 400 aa, Mycobacterium paratuberculosis
MPLSGPDMRDACGGGVGNVRSLTVMRGGRSGRSVRRGLAALCGLVLLTSGCARFNDAQSQPFTTAPELKPQPSSTPPPPPPLPPTPFPKACPAPGVMQGCLESTSGLIMGPDSKTALVAERTTGAVKEISVSAEPKVKTVIPVDPSGDGGLMDIVLSPTYQQDRLMYAYVSTPTDNRVIRVADGDIPKDILTGIPKGATGNTGALMFTSPTTLVVLTGDAGNPALAADPKSLAGKVLRIEQPTTVGQAPPTTALSGVGSGGGLCTDPVDGSLYVADRTPTADRLQRITKTSDVSTVWTWPDKPGVAGCAAMDGTVLVNLINTKMTVAVRLAPNTGAVTGEPDVVRKDTHAHAWALRMSPDGNVWGATVNKTAGDAEKLDDVVFPLFPQGGGFPRNNDDKT

SEQ ID NO: 4464 - protein, 503 aa, Mycobacterium paratuberculosis
MSVAANAELMDYDDVIARFDPVLGLEVHVELSTVTKMFCGCTTAFGAEPNTQVCPVCLGLPGSLPVLNQAAVESAIRIGLALNCEIVPWCRFARKNYFYPDMPKNYQISQYDEPIAINGYLEAPLDDGTTWRVDIERAHMEEDTGKLTHIGSETGRIHGATTSLIDYNRAGVPLIEIVTKPIVGAGERAPQIARAYVTALRDLLRALGVSDVRMDQGSMRCDANVSLKPIGTAEFGTRTETKNVNSLKSVEVAVRYEMQRQAAVLASGGRITQETRHFHEAGYTSPGRVKETAEDYRYFPEPDLEPVAPSRELVERLRLTIPELPWLSRKRIQQEWGVSDEVMRDLVNAGAVDLVIETVKHGAPSEQARAWWGNFLVQKANEANIGLDELNISPAQVAAVIALVDEGKLSNKLARQVVEGVLAGEGEPDQVMNARGLELVRDDSVTQAAVDEALAANPDVAEKIRGGKIAAAGAIVGAVMKATRGQADAARVRELVLAACGQG

SEQ ID NO: 4465 - protein, 388 aa, Mycobacterium paratuberculosis
VVSGPGHKGYTGGMRNRGAIRGAVQQPAASAGAPGAPRPPGWRPGNDPAAATVPQPHGPAGRRPPAPSQRVSPPARPTPTLGATALDRFDQREDEAARFDWRGLVHRLTGIDLGPGKEATYENELRARIRAAVGAAFPIAVLNLKGGVGKTAVVEALGSTFAAVRDDRVLALDIDAGDLAERHGRHNPHSMANLLRGGPATRYEDIRALTYMNGFRLEVLGLPDYARTDWRLERQDVVKAFSMLRNHYSVVLVDCVKALNSSVMEAVLPESRALVVVTSPAIDAIRKTQTTLEWLRHNGYQRLMRSTVLAVNHVEPAKVDAVAVTELDRLSARVGATVVLPFDRHVHEGRKIALDRLSKESRRSYLEMAAALADMFPGRGEQRGRGPH

SEQ ID NO: 4466 - protein, 343 aa, Mycobacterium paratuberculosis
MRIGVLTGGGDCPGLNAVIRAVVRTCDSRYGSSVVGFQDGWRGLLENRRIQLHNDDRNDRLLAKGGTMLGTARVHPDKLRAGLNQIKQTLDDNGIDVLIPIGGEGTLTAAHWLSEENVPVVGVPKTIDNDIDCTDVTFGHDTALTVATDAIDRLHSTAESHQRVMLVEVMGRHAGWIALNAGLASGAHMTLIPEQPFDVEEVCRLVKRRFQRGDSHFICVVAEGAKPIPGSISLREGGIDEFGHERFTGVAAQLGAEVEKRINKEVRVTVLGHVQRGGTPTAYDRVLATRFGVNAADAAHAGEYGQMVSLRGQDIGRVPLADAVRQLKLVPESRYDDAAAFFG

SEQ ID NO: 4467 - protein, 493 aa, Mycobacterium paratuberculosis
VNEIIRSDAATLAARIAAKELSSVEVTQACLDQIAATDERYHAFLHVAADEALGAAAVVDEAVAAGERLPSPLAGVPLALKDVFTTVDMPTTCGSKILQGWRSPYDATVTTKLRAAGIPILGKTNMDEFAMGSSTENSAYGPTRNPWNVERVPGGSGGGSAAALAAFQAPLAIGSDTGGSIRQPAALTATVGVKPTYGTVSRYGLVACASSLDQGGPCARTVLDTALLHQVIAGHDIRDSTSVDAPVPDVVGAARAGTAGDLKGVRVGVVKQLRGEGYQPGVLASFEAAVEQLTALGAEVSEVDCPHFEYALAAYYLILPSEVSSNLARFDAMRYGLRIGDDGSHSAEEVMALTRAAGFGPEVKRRIMIGTYALSAGYYDAYYNQAQKVRTLIARDLDAAYESVDVVVSPATPTTAFGLGEKVDDPLAMYLFDLCTLPLNLAGNCGMSVPSGLSPDDDLPVGLQIMAPALADDRLYRVGAAYEAARGPLRSAI

SEQ ID NO: 4468 - protein, 98 aa, Mycobacterium paratuberculosis
VSQISRDEVAHLARLSRLALTDAELDSFAGQLDAILTHVSQVQAVDVTGVEPTDNPLKDLNVTRPDEPMPCLTQAEALAEAPEAVDGRFAVPQILGDE

SEQ ID NO: 4469 - protein, 212 aa, Mycobacterium paratuberculosis
VLAVPSYLLRIELLDRPGSLGSLAVALGSVGADILSLDVVDRSSGYAIDDLVIELPAGAMPDTLITAAESLSGVRVDSVRPHTGLLEAHRELELLDHVAAADDKTARLQVLVDEAPKVLRVSWCTVLRSAGGELHRLAGSSGAPETKADSAPWLPLERAMTLDSSGDWVPKAWRDMDMTMVAAPLGDPHTAVVLGRPGPEFRPSEVARLGYL

SEQ ID NO: 4470 - protein, 144 aa, Mycobacterium paratuberculosis
LGLFGYLAVLAGVTELVLAVFVFAFVKRLLGRQPTPIGEEIGGTRRALDKLRKGEPMSQEEFDCAAQTIADRSSPLAFSIPAAVFTIGCFIVFSTLELHGVRSLRIYIGLFPILGATNLTVQLLRVAALKRRLPRANVVAASKT

SEQ ID NO: 4471 - protein, 972 aa, Mycobacterium paratuberculosis
MTTDQATRSVVAQTIRRLSVPILLVWVAVAAISNIAVPNLEDVAKAHNVSLNTPAAPSFQAMQHIGKVFHEYDSDSAAMIVLEGDKPLGDDAHRFYDALVGKLEHDTKHVEHVQNFWGDPLTAAGSQSKDGKAAYVQVYLAGNQGDALANESVDAIRNIVEHTPPPPGVKAYVTGAAPLVTDQFEVGSKGIFKVTVITVLVILAMLLWVYRSVTAVFVLVTVIVEMAAARGIVAFLGSVGLIGLSTYATNLLTLLVIAAGTDYAIFFVGRYHEARHEGQDRETAYYTMYRGTTHVVLGSGLTVAGAVLCLRFTRLNYFQSLGIPAAIGIGVALAAALSLTPAVITVGSLFGLFDPKRQMATRGWRRIGTAIVRWPGPILVVATGVALVGLLALPGYRTNYDARPYMPASAPANTGYTAAERHFSQARLNPELLMIETDHDMRNPADMINLERVAKAIAHLPGIAQVQSMTRPLGTPIEHTSLAFQISAGSIGSIENLQYQKERAEDLLKQADNLKDTIGILNQQYALQKQLAASTHDETQSFHDTIAIINDLRDKIANFDDFFRPVRSYFYWEKHCFDIPACFAFRSVFDALDGIDELSAQFEKLTASLDKLDAGQQKLVTLLPPQIADQEKNLALTLSNYATNLGINAQTRANTDTATALGQAYDAAKNDDSFYLPPEAFTNPEFKRGLKLFLSPDGKAARMIISHEGDPATPEGISHIEPIRNAAKQAVKNTPLGDSNIYLAGTAATYKDIAEGAKYDLLIAGIAALSLILLIMVLITRSLVAAIVIVGTVALSLGASFGLSVLVWQDILGIKLYWICLALSVIILLAVGSDYNLLLISRFREEIHAGLNTGIIRSMAGSGAVVTSAGLVFAFTMASFVSASLLVLGQIGTTIALGLLFDTLIVRSFMTPSVAALLGRWFWWPQRVRPRPASTMLRPYGPRPAVRQLLLWEDGDPAVAPETPSAARHSRG

SEQ ID NO: 4472 - protein, 77 aa, Mycobacterium paratuberculosis
VATINYVDINVQPRQVLNAALPWSLTMVTTQPGAFSNLVAQGNSDSLGCRITVDGDVKDERIVNQVNAYTFCLVKSA

SEQ ID NO: 4473 - protein, 115 aa, Mycobacterium paratuberculosis
VKGFSIASLVKRGWMVLVVVVVVGVAGFCVYRLHGIFGSHNNTSAAGGISDQTEPFSPKHITLEVFGNPGGGGDHQLRGHQCPAAAGAQRSPAVVVDHGDDPARGLQQPGGAGQQ

SEQ ID NO: 4474 - protein, 115 aa, Mycobacterium paratuberculosis; identical to SEQ ID NO: 4473

SEQ ID NO: 4475 - protein, 115 aa, Mycobacterium paratuberculosis; identical to SEQ ID NO: 4473

SEQ ID NO: 4476 - protein, 370 aa, Mycobacterium paratuberculosis
MSGNYGDSTRSLKAVDPQAVSGQPVAPQPVLAATYHLSGDETAGVDSYGRNSNPTWRQLESALAELEGAGGALVFGSGMAAISAVLRALAPPGSTVVVPADGYYQVRRHAAEDLAPAGVTVIEASSAQIYDAAATADVVLAETPTNPALDVVGLHRLAIVCHGRGARLVVDNTAATPLGQQPLSLGADAVVASATKALSGHSDLLAGYVATSRPELLAAVERQRLLAGAILGGFEAWLLLRSLGTAGLRFERQCQNARAVATLLARHPAVRAVRYPGLAEHPGHAVARAQMRRFGGLVAVELADAAAVRALLDGSELLIASTSFGGLHTSVDRRARWGDAVPDGFARISLGIEDTDDLLADIERALLTLR

SEQ ID NO: 4477 - protein, 649 aa, Mycobacterium paratuberculosis
RAVQRAARPGGAPPRAAGGRFAHAAGRRGGFRHRLRRGGAPGADAEPRRRLRHRRANRLEQSRRERDRQGPALPVRAQDRRGGPVAGLPRRPAGTRRHPGRRPGRRGRDAQRTHHRRRARTPLAQRRLPGSGAARGARRGVLPARRLRGAQRQPGRRRQGAVRQSAQQRGRVAAPEEPGRHRAAQAADDLPRHRPHRGVLAENPARGLHRAERVGAAGGRTDRAGARAGRGAGADRLLGRAPLRPATRDRRCGGQSRRRRVAAPARRHLARAAVGGRLQVPAPGGADQAPRHPRQRRAHRARHPVCVHDPGQGGRVDGGAGHPAQRRRGQAQGRADRRHRDDPQGRRRDPRGAGPGRRPARRHRTRIRHAHNVSRVRHPAGAGQGGRRRHPLPQRPVLPGAAARAGVSRRRPRRTRHRGAGLRGGHRAAQGRGDRRRGRLVRAHRGRPAAHRAVPDQGRHVVRERHTAAAEPAEGEKGCAVACFGGAVDPARGADGGARPGDRVRRSGLDHVGVHRAARRGGGGRPDDRGGAHRMVHRRLAPRDRGQVAGRRRADGRRARRQRAAHAGGADGGGHRVAGRFLPRRRQGGDPGARRQGRRFGVEEDRLRGGRRFAGLQVRQGGRARRAHPGRGRLPQAAGRGPARNPGGL

SEQ ID NO: 4478 - protein, 342 aa, Mycobacterium paratuberculosis
VSAFARPFATASGVGSWPGTVAREAAEVVVGELAGALAHIVELPARGVGADMLGRAGALLVDVAIDTVPRGYRLVARPGAVTRRAISLLDEDMDALEEAWEAAGLRNDGRVVKVQAPGPVTLAAEIELANGHRAITDPGALRDLAASLGEGVAAHRARLSRRLETPVVVQFDEPSLPAALGGGLPGVTALSPVPPLDEALARGLLDGCVHTVGGEVLLHCCGPDMPWNLLQDSAFSAVSVDASALGAADLDGMAAFVESGRAVALGVVAVGVPPRRPSAEQVAGAVVAVTDRLGFTRSALRDRIGVTPACGLAGATPEWARTAIGLARRAAELFAEDPDAIE

SEQ ID NO: 4479 - protein, 214 aa, Mycobacterium paratuberculosis
VSQKANGRWLPLLGAVVLLAAACSRVVDGAAVPGPGANHRVVQGVDVDAILLDQSRMRAITGAGEHLSIIPSMDGTSPVDIEALAQTAPPECRFIYAETATFGRDLEAFHKTTFQDPPDGALISEGAAAYRDADTARRAFGSLVGAVTDCANGSGGQLYVGDWNADAGSLHLRPGGCGRDYRILSVAMLEVTFCGFAQSVSDIVMTNIAANVPR

SEQ ID NO: 4480 - protein, 358 aa, Mycobacterium paratuberculosis
VRVLAAMSGGVDSSVAAARMVDAGHDVVGVHLALSTAPGTLRTGSRGCCSKEDASDARRVADVLGIPFYVWDFAEKFQADVIDEFLSAYARGETPNPCVTCNQKIKFSALSAKAVALGFDAVATGHYARLSGGRLRRAVDKDKDQSYVLAVLSAEQLRHAAFPIGDTPKPQIREEAARRGLAVAEKPDSHDICFIPSGNTRAFLGERIGVRRGAVVDADGTVLAEHDGVHGFTIGQRKGLGIAGPGPDGRPRYVTAIDADTATVRVGEASDLDVREMLGRAVVFTSGTAPSGPFECAVQVRAHGETADAVAELVGDELVVRLRAPLRGVAPGQTLALYRRDPDGDEVLGSATIAGTSR

SEQ ID NO: 4481 - protein, 392 aa, Mycobacterium paratuberculosis
MVYLDHAATTPMHPAAVEAMTAVLGTVGNASSLHTSGRAARRRIEESRELIADKLGARPSEVIFTAGGTESDNLAVKGIYWARRDAEPRHRRIVTSEVEHHAVLDSVNWLVEHEGAEVTWLPTAADGSVSPAALREVLTRHDDVALVSVMWANNEVGTVQPVAELAAVAAEFGVPMHSDAVQAVGQLPVDFTASGLSAMSVTAHKFGGPPAVGALLLRRDVACVPLAHGGGQERDIRSGTADVAGAVGMAAAARISVDGLETNSARLRALRDRLVDGVLGGIEDVTLNGARDPLRLPGNAHFTFRGCEGDALLMLLDANGIECSTGSACTAGVAQPSHVLVAMGVDPASARGSLRLSLGHTSIDADVDAVLRVLPGAVERARRAALAAAGAS

SEQ ID NO: 4482 - protein, 330 aa, Mycobacterium paratuberculosis
MQAPAGGGHSWLPRASCDARCVAAGRPAAERRLRVVVRVTLRLVLAVLLAPGWPLLAVPLPGRTRVQRIYCRLVLRCFGVRITVSGNPIRNLRGVLVVSPHTSWLDVFAIGAVLPGSFVARADMFSGPATGVVARILKIIPIERSSLRRLPGVVDAVAHRLRAGQTVVAFPEGTTWCGRDGDDAGGGGGPSHTSGDDAGRGAAGGGGGPSHRGRGAFYPAMFQAAIDAGRPVQPLRLTYQHVDGSTSTAPSLRRRRDAAGLDPPAAHRAAHAGAGAGRVAAAARDRPARPGRALPVRGGRGGGPARWSRARAGGLSPPAGRYRGSGHGLP

SEQ ID NO: 4483 - protein, 281 aa, Mycobacterium paratuberculosis
MSIASVLIPSDHPSGSATGSSAAPRYSLLLSADPVMIEAAQRLRYEVFTSTPGFALPSADGSGRDVDRFDEFCDHLLVRDDDTGELVGCYRMLAPAGAIAAGGLYTATEFDIRAFDPLRPSLVEMGRAVVRDGHRNGGVVLLMWAGILAYLDRYGYDYVTGCVSVPIGDADDAPPGSRLRGVRDFVVSRHGAPARYRVRPHRPVVVDGTALDDIPPPARPSVPALMRGYLRLGAQVCGEPAHDPDFGVGDFCVLLGKQDADTRYLKRLRSVSAAAELAGGR

SEQ ID NO: 4484 - protein, 281 aa, Mycobacterium paratuberculosis; identical to SEQ ID NO: 4483

SEQ ID NO: 4485 - protein, 238 aa, Mycobacterium paratuberculosis
MTNIVVLIKQVPDTWSERKLTDGDWTLDREAADAVLDEINERAVEEALQIREREGGEGSVTVLTAGPERATEAIRKALSMGADKAVHLKDDGMHGSDVVQTGWALARALGTIEGTELVIAGNESTDGTGGAVPAIIAEYLGLPQLTHLRKLSIENGKVTGERETDDGVFNLEATLPAVVSVTEKINEPRFPSFKGIMAAKKKEVTVLTLAEIGVEPDEVGLANAGSSVLSSTPKPPKT

SEQ ID NO: 4486 - protein, 274 aa, Mycobacterium paratuberculosis
MSALVPDVPPHPPAGTAPAGDAVMMLTGERTIPGLDIENYWFRRHEVVYQRLARHCAGRDVLEAGCGEGYGADMIAGVARRVIAVDYDEAAVAHVRGRYPRVDVMQANLAQLPLPDSSVDVVVNFQVIEHLWDQTQFVVECARVLRPSGLLLMSTPNRITFSPGRDTPINPFHTRELNAVELTELLVGGGFRDVSISGLFHGPRLREMDARHGGSIIDAQIARTVADDPWPPQLAADVAAVTVDDFELVPSGADAASGHHIDDSLDLIAIAVAP

SEQ ID NO: 4487 - protein, 534 aa, Mycobacterium paratuberculosis
VNSSHDRVPGLFTLVLHTHLPWLAHHGRWPVGEEWLYQSWAAAYLPLLRVLDTLAGEDRRGLLTLGVTPVVNAQLDDPYCLDGMHHWLANWRLRAMEAASVRSAPRSKSAGYQACTPEALRALGIRESAEAERALDDFATRWRHGGSPLLRRLLDAGTVELLGGPLAHPFQPLLAPRLREFALREGLADAALRLGARKGRGPGGIWAPECAYAPGLEHDYAAAGVTHFMVDGPSLHGDTALGRPVGDTDVVAFGRDLQVSYRVWSPKSGYPGHPAYRDFHTYDHLTGLKPARVTGRNVPSESKAPYDPQRADHAVDLHVADFVDVVRNRLTSESERIGRPAHVVAAFDTELFGHWWYEGPTWLARVLRALPEAGVRVGTLHDAIAGGFVGDPVDLPPSSWGSGKDWQVWAGDQVADLVQLNSEVVDTALSTVDKALSQAGSQPAALDGPVPRDRVADQILRETLLTVSSDWPFMVSKDSAADYARYRAHLHAHATREIAGALASGRRDTAQRLADGWNRADGLFGALDARRLPR

SEQ ID NO: 4488 - protein, 534 aa, Mycobacterium paratuberculosis; identical to SEQ ID NO: 4487

SEQ ID NO: 4489 - protein, 433 aa, Mycobacterium paratuberculosis
LARQAGRVRAALAAVVADTAVTEAASLKDGRATLALPGGLRWVAVHQPDGYHPPRRFVDSIGGDGLAALPARIAVRWRHIHEFEDVGGDRTRVIDRVETPVPASLLRPMFDYRHRQLAGDLAAHRLAAEHGLRPLTVAITGSSGLVGSALTAFLRTGGHRVIRLVRRAARGGDERRWDPEDPDPGLCDGVDAVVHLAGASIAGRFTDRHREAVRDSRIGPTRRLAELLGRGRPRPAALISASAIGYYGYDRGDETLTEDSDRGDGFLADVVADWERAITLALDAGVRVVQVRTGIVQSPRGGTLKLMRPLFSAGLGGRLGDGRQWLSWIGIDDLIDVYHRALWDSRLNGPVNAVAPQPVRNSEYTTALAAVLHRPAVLPVPSLGPRLLLGGQGARELAGASQRVAPAKLAAAGHRFRHPDIERALRHLLGRGG

SEQ ID NO: 4490 - protein, 253 aa, Mycobacterium paratuberculosis
LRQRKFRACGRPKVVRSGGFPSTQNGNPRPVNVFELATAPFGWGSAIRGKRFFHPDGVLAGGVVERVAPAGRGLPIPPSRIVARLSKATGTPGALPDFIGLALRVNAPQPAGTPWDILLVSAGSGVLSRAVALRPATSWNAQTLTTLMPLRYQDANWWLRARTAGDIGGARLALDDVRRRLERGGIEVSLDQACGRGDFTPLARVSLTAVIDDDVSFDPVVNTAPGVSLHPRWLADLRARAYRHSRDGRDADQ

SEQ ID NO: 4491 - protein, 244 aa, Mycobacterium paratuberculosis
MEKLGRRCGRLAGASALAVILLWAAPGHATADPAVTASPGMEIHQGHAVCMVGLVEPRLRVAITSGQCDGGQSAVTDRDHHPIGEVVLGRRQLDTDSADASTLPVEYEVIALARDVTASDLLPTGRRLLAAPGLRAVPGLPVCQLRRSTGQHCGSVGTVTGGRFAIADMVVDGRDVGGPVYALTDDGNAVIVGLFEGMVRSSPQFESWQAVMAQVYVDGRLPGAQQQLPALRMIDWRTGSFAAA

SEQ ID NO: 4492 - protein, 163 aa, Mycobacterium paratuberculosis
MAVLHPARSADRFDPADCRYMADFARAHLFVYARSLGTVLRVDGEVDASNARDLTATIRRFGRLKTPLVLDLSRLRFISVESFRALLLLNDELRKSRVHCCVVPGAAIRALLRLVHDNGLALADSVPEAFQNIEDIVRARREFLSDLARPRPARTHAGSSAAS

SEQ ID NO: 4493 - protein, 382 aa, Mycobacterium paratuberculosis
VPSGRERWDTMGALSFSPTTTAAAPAWTRIDDFGGWRAHVRAMVLDEVADFVGMRRADELDRAGIGTAGDILVQFVSGGKCLRSTFVYLGWLCGAPRDRAALRAAASFELLHAFALLQDDVMDGAQERRGRPAAHLQFGRWHQDRGLSGSPRRFGESAAILLGDLCLIWAEQMLRDSGLEARRLQRAWPRYDAMRVELAVGQFADLTNDIRQSPGLDAVLEVARRKSGNYTVRRPLEIGATMAGCDDRTVARLSRYGAAVGEAFQLRDDVLGVFGSPAVTGKPCAADLFERKATAVVVSAHQLADPPVRRELIELATRDVLDAAAIERWKALIVETGAVRLIERMISDRVASAREQLCGLPVDESVRAALAEMAAVCTDRAE

SEQ ID NO: 4494 - protein, 506 aa, Mycobacterium paratuberculosis
MRAIEGSADHVVVIGAGLAGLSAALHLAGRGRAVTVVEREAWPGGRAGRRDIDGYRIDTGPTVLTMPDIIEDTFAAVGDTLARRLELCTLDPAYRAVFADGSSLDIHRDPDRMADAVAEFAGREQATGYRRLRAWLTRLYRTEFDGFIAANFDSPLSLLTPRLAQLIAIGGFRNWDRMVKRYLSDPRLQRIFTFQSLYAGVAPRDALAVYAVIAYMDTVSGVVFPRGGVRALPDALAAAASDAGVQFRYGTTVTALEKTGGRVGAVLTEQAGRISCDAVVLTTELPQTYALLGRTPRRALRLRHSPSAVVAHVGCPAVASQTAHHTILFGDAWDHTFADIIGAGQLMRDPSLLVTRPTASDPTLAPRGRDLLYVLAPAPNLESGGIDWDSVGRGYVDDLIALVGQRLLPGLPGSATVLDVVTPADWARRGMAAGSPFALAHTFAQTGPFRPANMVRGIDNAVLAGSSTVPGVGVPTTLISGRLAADRITGVSKRTPARIDMKAGSP

SEQ ID NO: 4495 - protein, 243 aa, Mycobacterium paratuberculosis
VRARRLQRLSERLFSGGAHADDPLVAAVTHTARRYRISSQLFADFLASMRMDLTVTDYPDREALNRYMRGSAEAIGLQVLPILGTVTPVDEAAPYAAALGRAFQLTNFLRDVDEDLARGRVYLPADELAADGVDRELLMWCHEHRRTDPRVRRALIAQHHIARQTYRFATAGIAVLQHRSRPCVAAAAALYSEILDCIEKSDFAVFDHRATVGTARRLRVGAVGLIRSWRARNSGRGIRSGAA

SEQ ID NO: 4496 - protein, 107 aa, Mycobacterium paratuberculosis
MSDRWQYLVVLAACLVVTAPLEIAGAGVYRRWRRLAAAVLPVAAVFLLWDEIAVAARVWTYDHAYLCGLSIPVRVPIEELLFFLIIPVCAVLTYNAVSTILDKVRRR

SEQ ID NO: 4497 - protein, 103 aa, Mycobacterium paratuberculosis
MTGLGYTLPAALAVVIVCAAELTVLRTGLFRRPAYWLSMLIVLGFQVPVDGWLTKRSSPVVIYDDRQISGLRFPFDIPVEDFLFGFAMVTAVLLLWERRRARR

SEQ ID NO: 4498 - protein, 241 aa, Mycobacterium paratuberculosis
VRAGDTRPAPGNLAAAFDAGAATYDRLVGASPGYHAQLLLSARRMRIPHDGKGLRLLDAGCGTGASTAALLAVAPAADIVAVDASRGMLEVALAKRWPASVRFVHAPVQRLAEHGISGPFDGVLAAYLIRNVADRDEQLRRFRTLLRPGATLAVHEYSVRDSAAATLAWHALCWGIIIPAGWWRSGDTALYRYLWRSVLAFDGATRFRARLADAGFTAVHSETMPGWEAGIVHTFLADAPS

SEQ ID NO: 4499 - protein, 509 aa, Mycobacterium paratuberculosis
MTAGATDRRRRILPAPTGLPDAGALPSRPRVAVVGGGIAGLTAATGLAERGVAVEVIEREHYLGGRVGGWTEHHDGTDLAMNRGFHAFFRQYYNLRALLVRLDPRLRMLVPVNDYPLIDAAGRRDSFRGLPRTPPLNAMAFAVRSPTFRLRDFARIDARAAAPLAAVSVPGTYRRLDHIDAATFLEDIRFPEAARHLAFEVFSRSFFADPAKLSAAELATMFHIYFLGSAEGLIFDVPSANYDSALWQPLRSYLEQRHVRFRLGTSVGSIDAANRFAVHTDTDEELEVDAVVLATDVAGLQRIVAASRGLANGEWRDRIAGLRTAPPFAVHRFWLDRPVSPRRPAFLGTAGHKPLDNISVLDRYEREARAWAGAHHGSVVELHSYALDSAPSGAAALRELRRIYPETAAAQIVHETLLHRSDCPLFAPGGYPHRPTVVTPTPGLLLAGDAVRIDLPVALMERAATTGWCAANHLLKRWGLAGHPLVTVPTEGRSRLLRWLANREGATRS

SEQ ID NO: 4500 - protein, 336 aa, Mycobacterium paratuberculosis
MNIRALLRQLRPSVRAKDWPLQVIPRTPWADQRPTFREAQPAVIDAALQRCRRQPTGNWYAFAASTHVERGRPLGARVAGVDLVAWRDARGALCVGPRSCPHLGADLATGTVCGGTLICRWHGLPLDGRAREFGWAPLPSHDDGTLAWVRLDAVGGETPSPRPVIPPRPAGHTLASVAHLVGVCEPADIIANRLDPWHGAWFHPYSFTRLEVLATPTEDANRFLVAVTFRMGRLGVPVVAEFDCPEARTIVMRIVDGEGTGSVVETHATPIGSGPDGRPRTAVLEAVIAHSDRPGFARALWAAPLLTPVMRYAAGRLWRDDLAYAERRYEVRSQNR

SEQ ID NO: 4501 - protein, 61 aa, Mycobacterium paratuberculosis
LLSGNSVPHAEDDDGYYHCFQEIEQLVRGRLADGQRHRHETALKERRRTGGHPAHTSAPHD

SEQ ID NO: 4502 - protein, 188 aa, Mycobacterium paratuberculosis
VTKRGAADRRLDRTELEKLMSADMRAITAQSDRIGRHFARQNNVSGTDFHALLHIMVAETAGTPLTPAQLRQRMDVSPAAITYLVDRMIDAGHIRREPDPQDRRKTLLRYEKPGMALAHSFFTPLGAELRDALAHLSDRDLAAAHRVFAAMIEAMSAFESRLAASTSKPPAAPGRKRATTAGRRGAPR

SEQ ID NO: 4503 - protein, 329 aa, Mycobacterium paratuberculosis
MSHRNAPLSETGRLRLARCVVDEGWSLRRAAERFQVSVTTAERWARRYRELGEAGMADRSSRPHHSPNRTPTRTERRIIKVRVIRRWGPARIGYLLGIHPSTVHRVLTRYALAKLRWLDRSTGRIIRRMEPAGCGDLVHVDVKKLGKIPAGGGWRMLGRAIGGHNSNADKSSGVFSKHRNPIRGYHYLHTAIDGYSRLAYSEVLDDEIKETAAEFWTRANAWFAECGISVRKVLTDNGSCYRSRVFAQALGDIEHRRTRPYRPQTNGKVERFHRTLADEWAYARLYRSDTERCEEFTTWLHTYNHHRGHTALGGQPPASRVPNLSGQYT

SEQ ID NO: 4504 - protein, 344 aa, Mycobacterium paratuberculosis
MDAMTHRKRRHIDVCLSDPVEFDGVTTGLDRYRLPYHALTQTSLGDINVSTSFFGANLRAPILIGAMTGGAEMSKTINRNLAAAAQQLGIGMMLGSQRIMLDTALGERAADSFAVRDVAPDVLLFGNIGLSQLAKTAVPHLVKALDRVGADALAVHTNPLQEAMQHNGDTDFSGSLSRLREAAAALDYPVLLKEVGHGIGGAAAAELVGGEGQPPVAGIDVAGAGGTSWSRVEQFVRYGELRYPDLADWGVPTARAIVEVRRLLPGIPLVASGGIRTGMDAAKAIALGADVVAVARPLLPAAIESSAAVVDWLEPFIDGLRVCLHGCGVADLAGLRAVEPIRLA

SEQ ID NO: 4505 - protein, 687 aa, Mycobacterium paratuberculosis
VVWERVAAAVTGPRSWLLAAVAVLAGVGVMALVGPNAAAGQAPQSLPQHSPSARITALAGQFPGGDRTPLIVVVSRADGAVLGPADLGAARAARDRAQAAAQPGAAPAQPLTPSQDGKAALGIVPLSTTLSGLALNDAVSALRTAAATGLAADLQVHVTGGPAFGADIAGAFTHANVTLLAVTASVVALLLIATYRSPVLWLVPLLVVAFADRVAAAVGTAVASLTGLSFDGATSGITSVLVFGAGTNYALLLISRYRQELRRHAGHRDALRRAVHRAGPAIVASNATVVLALLTLLLAATPSTRSLGALAACGLVIAAVSVLVVLPPLLAVCGRRLFWPFIPVDRPATESGAWRRVAEWVAGRPALAAVAAVAVLAALGGGLWGTRIGLSQTEQFRVRADSVAGYHVLAQHFPAGLANPTLVVADTGHAAAVHQAIAATPGVVSATESGRSPSGLTQWSVVIDAPPSSVRAFDIVAALRDSTRAADSGALVGGADAAALDVRDAATHDRVLLIPAILAVILIVLAVLLRSVMAPPVLLVATMLGALGALGLGGWVSLHLFGFPALDYTTPLFAFLFLAALGVDYTIFLVTRAREETARHGTRQGMVEAVAATGGVITSAGIVLAAVFCVLAVLPLMVLTQLGIIVGLGILLDTFVVRTLVIPALFTLVGDRIWWPNNPARHERSTP

SEQ ID NO: 4506 - protein, 442 aa, Mycobacterium paratuberculosis
MPALLWFRRDLRLHDHPALSAAADSDEVLACFVLDPRLQRSSGPRRLQFLGDSLRVLRDELDGRLLVTRGRPDIRIPEIAKAIGASSVHVSEDFTPFGKRRDARVRAALASVPLVATGSPYLVAPGRVTKPDGSPYQVFTPFLRRWRDTGWRPPVKTGAASARWLDPARLGITDCEIPDPGATLDLAAGEEAARNKWKSFVDNGLANYADDRHRPDIEGTSRMSAHLKFGTIHPRTLVADLDLRAAAARAYLRELAFRDFYADVLHHRPASAWRNWNSAFDAIRTDTGAEAGRRFAAWKAGETGFPFVDAGMRQLRQTGFMHNRVRMTVASFLVKDLHLPWQWGAHWFLQQLVDGDLANNQHGWQWCAGCGTDAAPYFRVFNPAAQGEKFDPSGDYIRRWVPELRCADDPHLRTGERPPGYPAPIVDHATERAEALRRYRSM

SEQ ID NO: 4507 - protein, 254 aa, Mycobacterium paratuberculosis
VAASIGCPAMTTMWGAPLHRRWRGSNLRDPRQAKFLTLASLKWVLRNRAYTPWYLVRYWRLLKFKLANPHIITRGMVFLGKGVEIHATPELAQLEIGRWVHIGDKNTIRAHEGSLRFGDKVVLGRDNVINAYLDIELGDSVLMADWCYVCDFDHRMDDINVPIKDQGIVKSPVRIGPDTWVGVKVTVLRGTSIGRGCVLGSHAVVRGVIPDYSIAVGAPAKVVKNRQLSWESSAAQRAELAAALADIERKKASR

SEQ ID NO: 4508 - protein, 372 aa, Mycobacterium paratuberculosis
LQWTRSVKGSLAAGPALSARGYLGLNAQTPAGCSLMEWENTDNGRQRWCVRLVQGGGFAGPLLDGFDNLYVGQPGAFLSFPVTQWTRWRQPVIGMPTTPRFLGHGQLLVVTHLGQVLVFDSHRGQVAGSPLDLVDGVDPTDATRGLADCAPARPDCPVPAAPAFSAATGMVVLGVWQPGAPSAGLVGLKYHPGQSPLLTREWTSDAVGAGVIASPVLSADGSTVYVNGRDQRLWALRAADAKVKWSAPLGFLAQTPPAVTPQGLIVAGGGPDTRLAAFRDAGDHADQVWRRDDLIPLSSSSLAGVGYTVVSGPPANGAPGMSVLVFDPGDGHTLNSYPLPAATGYPLGVSVGTDRRVVAAISDGQVYGFAPA

SEQ ID NO: 4509 - protein, 227 aa, Mycobacterium paratuberculosis
MRYLLAAALLAPAVLLGWPAAAEPPSCAALGGSLEDGQMCRLRAAGPNYTINMVFPADYPDEQALTDYITQNRDGFVNVAQSSGGRDQPYQLEATTEQHSGGQPPHNTRSVVLKFFQDVGGTRSSIWYKAFNYNLGTKQPLTFDNLFAPNAAPLDAIFPIVQRDLERQTPLGAAILPSTGHDPSHYQNFAITDDQLIFYFAPGEMLPAFGGPVQAQVPRNAIPPLAI

SEQ ID NO: 4510 - protein, 365 aa, Mycobacterium paratuberculosis
LSDATRIADIAATRARFGERTPLLVETVLLRRRASEKLGELGVSDWLFTDEALQQATAAPVAVHRAGRLAGPGLVVHDVTCSIGTELAALRARGVTAVGSDIDPVRLAMARHNIGSAAWLCRADALHPVTRDAVLMVDPARRVDGRRRLRIDDYQPALSPLLDSYRGRDFVVKCAPGIDFEQVRRLGFAGEIEVTSYRGSVREACLWSAGLAAAGVRRRATVLDRGEQITDADPDDCPVRPVGRWIVDPDGAVVRAGLVRHYGARHGLWQLDPDIAYLSGDRLPATVRGLGVLEQLAFDERRLRQALTASDCGALEVLVRGVRVDPDALRKRMRLRGSRPLSVVITRIGARNSGQVTAFVCQPSR

SEQ ID NO: 4511 - protein, 323 aa, Mycobacterium paratuberculosis
MTRSTDAVPTPHATAEQVEAARHDSKLAQVLYHDWEAETYDEKWSISYDQRCIDYARGRFDAIVPEHVLRELPYDRALELGCGTGFFLLNLIQSGVARRGSVTDLSPGMVKVATRNGQSLGLDIDGRVADAEGIPYEDDTFDLVVGHAVLHHIPDVELSLREVIRVLRPGGRFVFAGEPTSAGDVYARELSTLTWRIATNVTKLPGLGSWRRPQAELDESSRAAALEAIVDLHTFTPGDLERMAANAGATEVRTVSEEFTAAMFGWPVRTFEASVPPGRLGWGWAKFAFNGWKTLSWVDANIWRRVVPKGWFYNVMVTGVKPT

SEQ ID NO: 4512 - protein, 257 aa, Mycobacterium paratuberculosis
VAALNEFVSVVVSDGSRDAGLAMLLVSRPPTNALSRQVYREVIAAADELGRRDDVAAVILFGGHEIFSAGDDMPELRTLRGAEAETAARVRRDAIDAVAAIPKPTVAAITGYALGAGLTLALAADWRISGDNVKFGATEILAGLVPGGDALARLTRVAGASKAKELVFSGRFFDAEEALALGLIDEMVAPDDVYDAAAAWARRFLDGPRHALAAAKAGVDAVFELPRAERLAAEQRRYVEVFSAGQGGDAGADPHGG

SEQ ID NO: 4513 - protein, 276 aa, Mycobacterium paratuberculosis
MTSPEEAPLVPRPAATVMLVRDAPAGLKVFLMRRHSRMEFAAGVMVFPGGGVDERDRNADLGGLGAWAGPPPQWWAQRFGIEPDLAEALVCAAARETFEESGVLFAGPAGAPDSIVGDASVYRDARRALADGTLSFADFLRTEKLELRSDLLRPWANWVTPEAERTRRYDTYFFVGALPQGQRADGQNTESDRAGWTTPEAALEDFSAGRTFLLPPTWTQLDSLAGRTVADVLAVQRQIAPVQPHVEIRGDNWVFEFFDSDRYHRAREAGGLGWRH

SEQ ID NO: 4514 - protein, 280 aa, Mycobacterium paratuberculosis
VPENDSAAADPDLLIELRDVSLRRGGNVLVGPLDWAVELDERWVIVGPNGAGKTSLLRIAAAAEHPSSGVAFVLGERLGRVDVTELRSRIGLSSSALAQRVPSDEVVRDLVVSAGYAVLGRWRERYEDIDYRRAVDMLESLGAEHLADRSYGTLSEGERKRVLIARALMTDPELLLLDEPAAGLDLGGREELVARLADLAADPDAPALVLVTHHVEEIPPGFSHCMLLSEGRVVAAGLLTDVLTSENLSTAFGQAIALDVVDGRYFARRVRTRAAHRRQL

SEQ ID NO: 4515 - protein, 411 aa, Mycobacterium paratuberculosis
VNSPPKVSVLITVTGVDQPGVTATLFEVLSRHGVELLNVEQVVIRHRLTLGVLVCCPADVADGPALRHDVEAAIRKVGLDVSIERSDDVPIIREPSTHTIFVLGRPITAAAFGAVAREVAALGVNIDLIRGVSDYPVIGLELRVSVPPGADGALRTALNRVSSEEHVDVAVEDYTLERRAKRLIVFDVDSTLVQGEVIEMLAAKAGAEGQVAAITDAAMRGELDFAQSLQQRVATLAGLPATVIDEVAGQLELMPGARTTLRTLRRLGYACGVVSGGFRRIIEPLAEELMLDYVAANELEIVDGTLTGRVVGPIIDRAGKATALREFAQRAGVPMAQTVAVGDGANDIDMLAAAGLGIAFNAKPALREVADASLSHPYLDTVLFLLGVTRGEIEAADAIDGEVRRVEIPPE

SEQ ID NO: 4516 - protein, 581 aa, Mycobacterium paratuberculosis
LTAEAPPLGELEAVRPYPDRTGPKGNLVYKLITTTDHKMIGIMYTVTCFAFFFIGGLMALLMRTELAAPGLQFLSNEQFNQLFTMHGTIMLLLYATPVVFGFANLVLPLQIGAPDVAFPRLNAFSFWLFLFGGLIAASGFIVPGGAADFGWTAYTPLSDAVHSPGAGGDLWITGLIVAGLGTILGAVNMITTVVCMRAPGMTMFRMPIFTWNILVTSILILIAFPILTAALFGLAADRHLGAHVYDAANGGVLLWQHLFWFFGHPEVYIIALPFFGIITEIIPVFARKPVFGYTTLVYATLSIAALSVAVWAHHMFATGAVLLPFFSFMTYLIAVPTGIKFFNWIGTMWKGQLTFETPMLFCVGFLLTFLLGGLTGVMLASPPLDFHVTDTYFVVAHFHYVLFGTIVFATFAGVYFWFPKMTGRLLDERLGKLHFWLTFIGFHTTFLVQHWLGDLGMPRRYADYLPSDGFQPYNVASTVGAFILGASMFPFVWNVFKSWRYGEVVTVDDPWGYGNSLEWATSCPPPRHNFTELPRIRSERPAFELHYPHMVERLRAEAHVGRAHGPADKDVTRLDDVQVRS

SEQ ID NO: 4517 - protein, 364 aa, Mycobacterium paratuberculosis
VLFGVIRPARLAAVTAALMVACGGCGSDRPAATTTRSLVTPTTQIAGAGVLGNDRRPDESCARDAAEADPGPAKRQVHNAPGADPAPVQVSADPQRIVVLAGDQLDALCALGLQSRVVGAALPDGASGQPAYLGGAVRGVPGVGSRSHPDVKAIAAAHPDLILGSQGLTPALYPQLAAIAPTVFTAAPGAAWRDNLRAVGAATARAGAVDGLLSGFSQRAGDVGARHDASHFQASIVQLTTGSIRVFGANNFPASVLGAVGVDRPAAQRFTDKPYLEIGATDADLAKNPDLSVADADVVYLSCATPAAADRAATVLDSGPWRKLSANRDNRVYVVNDEIWQTGQGLIAARGIVDDLRLVNAPIN

SEQ ID NO: 4518 - protein, 346 aa, Mycobacterium paratuberculosis
MSTVSAYAATSATEPLTKTTIERRDPGPRDVAIDIKFAGICHSDIHTAKGEWGHTNYPVVVGHEIAGVVTEVGAEVTKYKVGDHVGVGCMVNSCRQCSSCTAGLEQYCKRGATFTYNSIDRDGSVTQGGYSQAIVVDEDFVVRIPDSLPLDKAAPLLCAGITLFSPLRHWNAGPGTRLAIVGLGGLGHMGVKLGAAMGAEVTVLSQSLKKMEDGLRLGAKHYHATADPDTFTKLRGSFDLMLNTVSANLKLNDYLSLLDVDGTLVELGIPEHPMEVGAFPLALARRSLSGSNIGGIAETQEMLDFCAEHNVTPEIELIEPDYINEAYERVLASDVRYRFVIDISKL

SEQ ID NO: 4519 - protein, 137 aa, Mycobacterium paratuberculosis
VTNTAASQTVNFCRSVLRWLRAGYPEGVPGPDRVPLLALLRSTPLTEEQIAEVVREITKDGSPAIADGVINRDEIAEFISGMTHYDAGPENIIRVAARLAAAGWPLAGIDVSEVIPGDDFAESAEIAARGQTPGVAS

SEQ ID NO: 4520 - protein, 324 aa, Mycobacterium paratuberculosis
VSENMKLIDRVSAINWNRLQDDKDAEVWDRLTGNFWLPEKVPVSNDLQSWATLTAHEKQMTMRVFTGLTLLDTIQGTVGAVSLIPDALTPHEEAVYTNIAFMESVHARSYSNIFSTLCSTAEIDDAFRWSEENPNLQRKAEIVMQYYKGDEPLKRKVASTLLESFLFYSGFYLPMYWSSRAKLTNTADMIRLIIRDEAVHGYYIGYKYQRGLALVDDAKRQELKDYTYELLFELYDNEVEYTQDLYDEVGLTEDVKKFLRYNANKALMNLGYEALFPRDETDVNPAILSALSPNADENHDFFSGSGSSYVIGKAVVTEDEDWDF

SEQ ID NO: 4521 - protein, 170 aa, Mycobacterium paratuberculosis
VSPTPFDRFPSSMRRARCTIWYMFTEDSVEIDAPPRLVWDVFTDVERWPEWTASVTSLTGLDGPALAVGRRFAIKQPGMAKLVWQVTELIPGASWTWVQRSPGARVAATHHVSARPGGGTLVRQQLDQRGALGALVGRLMAKKTKRFLALEARGLKARAEQLSRADGAHP

SEQ ID NO: 4522 - protein, 181 aa, Mycobacterium paratuberculosis
MARTPDRQRRRELLDALIAEFAAGGIGDRSLRRVAEAVGTSHRMLLHHFGSREGLLLAIVEEVERRQMRVLTELPRAPAEGFAAMWADLRRPELREFERLFFECYSRAAQGEKPFARMLPDAVDDWLRQAETHSGAPFDPAMARLGLAVIRGLLLDLVATGDEAGVDAAARAFVNLLNAGA

SEQ ID NO: 4523 - protein, 500 aa, Mycobacterium paratuberculosis
VTDVVTHTETAPTPAAKAAKPVHTRAVIIGTGFSGLGMAIALQKQGVGFVILEKADDIGGTWRDNSYPGCACDIPSHLYSFSFEPKPDWKNPFSYQPEIWDYLKGVTEKYGLRRYIEFNSLVDRAHWDDDEHRWHVFTTDGREYVAQFLISGAGALHIPSLPDIEGRDEFAGPAFHSAEWDHTVDLTGKRVAVIGTGASAIQIVPEIVGQVAELQLYQRTPPWVVPRSNPEIPPAVRAAMENVPGLRALVRLAIYWGQEALAFGMTKRPNLLKVIEAYAKYNIRRSVKDKELRRKLTPHYRIGCKRILNSSTYYGAVADPKTELVTDHIARITPDGIVTADGTHRPVDVIVYATGFHVTDSYTYVQIKGLHGEDLVDRWNREGIGAHRGITVADVPNLFFLLGPNTGLGHNSVVFMIESQIRYVADAIATCDKLGAQALAPTRAAQDRFNDELQRRLGPSVWNSGGCSSWYLDEHGKNTVLWGGYTWEYWRATRAVKPQE

SEQ ID NO: 4524 - protein, 246 aa, Mycobacterium paratuberculosis
MPRPARPHSATKPGAKVDARSERWREHRKKVRNEIVDAAFRAIDRLGPELSVREIAEEAGTAKPKIYRHFHDKSDLFQAIGERLRDMLWTAIFPSIDLKTDSAREVIRRSVEEYVTLVDKHPNVLRVFIQGRSTGTPQSTVTILNEGREITLAMADLFDNELREMELDHAAVELAAHAAFGSAASATEWWLGPEPDSPRLMSRAQFVAHLSTIMMAVIIGTAETLGITMNPDQPIHDAVVRKPAVS

SEQ ID NO: 4525 - protein, 726 aa, Mycobacterium paratuberculosis
LEGTDVSPTVAAEPVTAGAHGLPDETDYHALNAMLNLYDADGKIQFDKDVLAARQYFLQHVNQNTVFFHNQDEKLDYLIRENYYEREVLDQYSRNFVKSLLDRAYAKKFRFPTFLGAFKYYTSYTLKTFDGKRYLERFEDRVVMVALTLAAGDTGLAEKLVDEIIEGRFQPATPTFLNSGKKQRGEPVSCFLLRIEDNMESIGRSINSALQLSKRGGGVALLLTNIREHGAPIKNIENQSSGVIPIMKLLEDSFSYANQLGARQGAGAVYLHAHHPDIYRFLDTKRENADEKIRIKTLSLGVVIPDITFELAKKNEDMYLFSPYDVERVYGLPFADISVTEKYYEMVDDARIRKTKIKAREFFQTLAELQFESGYPYIMFEDTVNRANPIDGKITHSNLCSEILQVSTPSLFNDDLSYAKVGKDISCNLGSLNIAKTMDSPDFAQTIEVAIRALTAVSDQTHITSVPSIEQGNNDSHAIGLGQMNLHGYLAREGIFYGSEEGIDFTNIYFYTVLYHALRASNRIAIERGTHFKGFERSKYASGEFFDKYTEQVWEPATEKVRQLFADAGIRIPTQDDWKRLKESVQAHGIYNQNLQAVPPTGSISYINHSTSSIHPIVSKVEIRKEGKIGRVYYPAPYMTNDNLEYYQDAYEIGYEKIIDTYAAATQHVDQGLSLTLFFKDTATTRDVNKAQIYAWRKGIKTLYYIRLRQMALEGTEVEGCVSCML

SEQ ID NO: 4526 - protein, 150 aa, Mycobacterium paratuberculosis
MDSTGRNLVYFSSVSENTHRFVQKLGIPAIRIPLHGRIEVDHPYVLLLPTYGGGRATPDLNAGGYVPKQVIAFLNNEHNRSLIRGVIAAGNNNFGAEFAYAGNVVSRKCGVPYLYRFELMGTQDDVDAVRAGLAEFWKEQTCHQPSLQSL

SEQ ID NO: 4527 - protein, 79 aa, Mycobacterium paratuberculosis
MTITVYTKPACVQCSATYKALDKHGIAYEKVDITLDPEARDYVMALGYLQAPVVVAGSDHWSGFRPDRIKALAGAELSA

SEQ ID NO: 4528 - protein, 88 aa, Mycobacterium paratuberculosis
VICDTPGRVSEFVRHRPYDQGISKLSFRTSCISTSSEPLGVVFRAPADPRTTEPRGRGGTPEIGAELSKTGLRHPTAAGRESGGLPDR

SEQ ID NO: 4529 - protein, 198 aa, Mycobacterium paratuberculosis
VRGWTPTTEGNWRIVAIKILALVGSLRSASINRQIAELASAVAGEDVVVTVFEGLGELPFYNEEIDDAMTSDAPPLAPVAALRAAAADADAALVVTPEYNGSIPAVIKNAIDWLSRPFGDGALKGKPLAVIGGSFGQYGGVWAHDETRKSFGIAGARVVESIKLSVPFKTLAGKAPAEHAELSANVRDVVGKLAAEVG

SEQ ID NO: 4530 - protein, 204 aa, Mycobacterium paratuberculosis
VSGVEQRGQLRFCDPRVPAPERGDAARNRALLLDAARRLVAERGADAVTMDDVAAAAGVGKGTLFRRFGSRAGLMMVLLDEDERAIQQAFLFGPPPLGPDAPPLDRLVAFGRERLRFAHTHHALLSAANRDPRTRYGPPSAVLRRHVRVLLAAAHTTGDLDAQADALLALLDADYVHHQISDHGHTLQTLGDAWESLARKLCGN

SEQ ID NO: 4531 - protein, 347 aa, Mycobacterium paratuberculosis
MSPRWVLHVDLDQFLASVELRRRPELAGLPVIVGGNGDPNEPRKVVTCASYEAREFGVRAGMPLRAAARRCPPDSGVTFLPSDPAAYDAASDQVMGLLRDLGHPVEVWGWDEAYLAVTATDPIEVAEQIRGVISSETGLTCSVGISDNKQRAKIATGFAKPDGVFVLTDANWMALMADRPVDALWGVGPKTAKKLADLQITTVWQLAHSDAELLTATFGPRTGLWLLLLAKGGGDDHVSAQPWVPRSRSHVVTFPRDLTDRAEMETAVTDLADQAVAEVLTAGRVVTRVAVTVRTATFYTRTKIRKLDAPSTDRDVIVAAALRVLDLFELDRPVRLLGVRLELVMPD

SEQ ID NO: 4532 - protein, 310 aa, Mycobacterium paratuberculosis
MAQKASGRYYAGKRCLVTGAASGIGRATALRLAAHGAELYLTDRDGDGLRLTVEDARALGASVPEHRALDIADYDQVASFAADIHAAHPPMDVVLNIAGVSAWGTVDRLTHEQWRKMIAINLMGPIHVIETFVPPMVAAGRGGHLANVSSAAGLVALPWHAAYSASKYGLRGLSEVLRFDLARHRIGVSVVVPGAVNTPLVNTVEIAGVDRDDPDVARWVRRFAGHAVSPEKAADKILAGVARNRYLIYTSPDIRALYAFKRLAWWPYSVVMRQVNVIFTRALRPAPATLVRHDQLETHPEQPDRPVELE

SEQ ID NO: 4533 - protein, 217 aa, Mycobacterium paratuberculosis
VVQGRGVTSHPANPEPGARRRGDKQRQAILAVVRELLQEKPFAELSVSTISLRAGVARSGFYFYFDSKYAVLAQLMAEATEELEELTQYFAPRQPGESPEQFAKRMVGSAAAVYAHNDPVMTACNEARHTDVEIRNLMDQQFEVVLAQIVGIVEAEMKAGTARPISDDLPTLIRTLAGTTALMLTGDPVLTGPDSDRDRRVAVLEQLWLHALWAGRP

SEQ ID NO: 4534 - protein, 492 aa, Mycobacterium paratuberculosis
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATAIVADWPTNDARFLFHPAMKELTLDIASLVFMGHEPGTDHDLVTTVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESARLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 4535 - protein, 179 aa, Mycobacterium paratuberculosis
PEKTVMTIPERNPLPHPESATAWFGDRFGVPLPRGLRERAEAMSWDAFVATYGRSGGPLRLGPWERTDSDCAATGLGSRAGNYRAVIAVGDQIGTATAAAAGPIAALTAMLHERGINLEILHFHQMRSATATATFIRGGNGARAEWAMGWSPDPTRSALRAVIACANRLFAPQWSDGSR

SEQ ID NO: 4536 - protein, 322 aa, Mycobacterium paratuberculosis
VTADDETRQYGFVHAALIYRSQQEFLDVVAGFVGDGLAGNEAVLLAVPPALMALLRDELYAGGEPPAGVRMADITESARNPSRFMAMQGAFVDEHPDRRVRIVSQLAWPGRSREEFVACIEHEALVNEAMDGYPATALCLYDASTLDDGVLADARATHPLLCKSGALQRSPDYAPGEVLERCNQPLPANPGAVTYLVRRSADLRPARSFAVDYAGWVGLSQESIEDLQLVATELATNSLMYTGGACRLAFWQDDRYLVCEARDTGRFDDPLVGRLDPGPCGPASRGLYLVNAISDLVRTHTTSTGTTIQAYLCFEPAVRPTG

SEQ ID NO: 4537 - protein, 485 aa, Mycobacterium paratuberculosis
MNAEPRTGPAKTLASALARDIEAEIVRRGWAVGESLGSEPALQQRFGVSRSVLREAVRLVEHHQVARMRRGPNGGLYICEPDAGPATRAVVIYLEYLGTTLADLLNARLVLEPLAASLAAERIDEAGIARLRAVLHAEQQWRPGLPMPRDEFHIALAEQSKNPVLQLFIKVLMRLTTRYALQSRTDSETEALEAVDHLHTHHSRIVAAVTAGDPARAKTLSERHVEAVTAWLQRHHAGDRNRGRTPRRPLNSEVPQGKLAEMLAATIGDDIAADGWRVGSVFGTETALLQRYRVSRAVFREAVRLLEYHSIAHMRRGPGGGLVIAEPAAQASIDTIALYLQYRDPSREDLRCVRDAIEIDNVAKVVKRLAEPQVAAFVASRRSGLPDDSRQTPDDVRRAIAEEFDFHVGLAQLAGNAPLDLFLRIIVELFRRHWSSTGQALPTWSDVRAVHHAHLRIADAVAAGDLSVASYRLRRHLDAAASWWL

SEQ ID NO: 4538 - protein, 400 aa, Mycobacterium paratuberculosis
VCMAHFEKDAILSGIGISRIGRRTGIPGLELTMEAVRAAVADAGLAPTDIDGIATLGDTLAADVNAQLGIDAADCGSGFGTGGLLSPVMSACRAVAERRARHVVVYRTIQMLGGTVPVKQEPNAAAPPLARMFETPEGEPKPAVGAMDDVNDLVAAHDYSAANWLALNCRRHMQLYGTRKEQLGWVALNGRRNAALNPLAVYRDPMTMADYLGARLVSTPLGLLDCDVPIDGSIAVVVSHLEYAPDCPHRAVQVEAIGGSDGAGGWFHRADYPKMAMSDAAAQMWSRTDLTAADLDVAQLYDGFTFLTLAWLEALGVCGDGEAGPFVEGGARIARDGELPLNTYGGQLSAGRMHGYWALHEGCLQLRGDAGERQVARRPQVGVVSVGGGPVAGCMLLTCR

SEQ ID NO: 4539 - protein, 121 aa, Mycobacterium paratuberculosis
VSDGPLRIEYCDGCARWVHPASGRCRDCGGALVAREVCGRGTVFTYTVNHHPYNPEIPTPYVIAIVELAEQSDLRVAANIVDCEPDSVACGMPVTLLPERGSGGGPAVRPGLSREPTRPGR

SEQ ID NO: 4540 - protein, 721 aa, Mycobacterium paratuberculosis
MGIALTDDHRELAEVARGFLTSQKARWAARSLLDATDEPRPGFWPNLVELGWLGLHIDEEYGGSGFGLPELVVVVEELGRAVAPGPFVPTVIASAVIAKNGTAEQKSRLLPGLIDGTVTAGIGLDSRVRLGDGAADGEAGIVLGAGLAGLLLIAAGDDVLVLERDRDGVSVDVPDNFDPTRRSGRVRLDNVRVSDADLLAGARPSALARARTLLAAEAVGGASDCVDAAVAYAKVRQQFGRTIATFQAVKHHCANMLVGAESGIAAVWDAARAAGEDEDQFHLIAAVAAALAFPAHVRNAELNIQVHGGIGFTWEHDAHLHLRRAVVTAALFGGDAPAADVFERTAAGTVRDNSLDLPPEAEELRTTIRADAAAIAALDKDAQLDKLIETGYVMPHWPKPWGRAADAVEQLVIEEEFRAAGIKRPDYGITGWVILTLIQHGTPWQIERFVEKALRKDEIWCQLFSEPDAGSDAASIKTRATRVEGGWKINGQKVWTSGAHYCARGLATVRTDPDAPKHAGITTVIVDMKAPEVEVRPLRQITGGSDFNEVFFNDLFVPDEDVVGTPNSGWTVARATLGNERVSIGGSGSFYEGLADQLVQLAQQRPDRLAGGKIRVGSYLAEETALRLLNLRRAARSVEGTGPGPEGNVTKLKLAEHMVEGAAIMAALLGPEVALTDGPGALSGRLMMGARGMAIAGGTSEVTRNQIAERILGMPRDPLIN

SEQ ID NO: 4541 - protein, 252 aa, Mycobacterium paratuberculosis
MEINGKKAVVVGGASGMGRASAELFAARGADVAILDRESSDGKAVAEGIGAAFYPVDVTDFAGTEETLQSAVDKLGGLHVIVTTAGGGIAKRTLTKNGPHDLESFQSVIDLNLIATFNISRLAAAHMAKNEPEDEERGVIINTASIAAFEGQIGQVAYTAAKAAIAGMCLTMARDLGSVGVRVLAIAPSLFATGLTQGIPDEFATQLTKDAAFPKRLGRPEEYAKLALAIVDNPMLNGQCLRLDAGQRFAPK

SEQ ID NO: 4542 - protein, 519 aa, Mycobacterium paratuberculosis
LSPSHAKLATVLLFDVATASADVGGTPSRLTKVARIADLLRRAAPNAALVAIVVSWLSGELRQRQIGVGWAALRSRPPAAAHPTLTVVAVDAAFAEIGAVAGKGAQARRAALLNALFAAATETEQTFLLRLLGGELRQGALAGIMADAVARAAGIPAAAVQRAAMLGGDLPAVAAAALSGEASALDAFTLRVGRPVAPMLAQTAAGVAQAIERHGGQAIFEAKLDGARVQIHRAGDQVTVYTRSLDDVTARLPEVVTATLALPVEALIADGEAIALRPDNSPQRFQVTASRFGRSLDVAAAVAAQPLSVFIFDILHCDGIDLLDAPTTDRLAALDALVPPAQRVDRLLTADPDAAGRFLEATLAAGHEGVMAKAPGAPYQAGRRGAGWLKVKPVHTLDLVVLAVEWGSGRRRGKLSNIHLGARDPATGEFVMVGKTFKGMTDAMLDWQTARFTELAVGGTDGYVVRVRPEQVVEVAVDGVQKSSRYPGGLALRFARVLRYRDDKGPAEADTIDAVRALY

SEQ ID NO: 4543 - protein, 747 aa, Mycobacterium paratuberculosis
VAITERDDGVSYVHTDHNLPPVAIVDRSPITARHRIVFAVIAFARGEPVNAVWFVVAAICSYLIGFRFYARLIERKIVHPRDDHATPAEILDDGADYVPTDRRVLFGHHFAAIAGAGPLVGPVLAAQMGYLPCTIWIVAGAVFAGAVQDYLVLWISTRRRGRSLGQMARDELGASGGLAALLGAFVIMVIIIAVLALVVVRGLAQSPWGVFSIAMTIPIAVFMGCYLRFLRPGRVAEVSVLGFALLLIAVATGSWVAETPWGASWLSLSPVTVSWLIIGYGFVASVLPVWLLLAPRDYLSTFMKVGAIALLAVGICIARPVMQAPAVSHFASRGDGPVFSGALFPFLFITIACGALSGFHALISSGTTPKLLEKESQMRLIGYGGMLTESFVAVMALISAAVLDQHLYFTLNAPAAQTGGTAATAAHYVNGLGLPGAPTTVDQLNRAAAAVGEKSIVSRTGGAPTLAVGMAEVLYRVFGGAGLKAFWYHFAIMFEALFILTAVDAGTRVARFMLSDTLGNLGGPLARLRNPSWRPGVWLCSLAVAAGWGGILLMGVTDPLGGINTLFPLFGIANQLLAAIALTVITVIVVKKGLLKWAWIPGAPLLWDLVVTLSASWQKIFSADPAVGYWTQHFQYLAAKSAGRTSFGSARNAHQLDQVIRNTFIQGSLSIAFAAAVVVVVIAGVLAALGAIRGPASRLSRPLTEDEPVPSALFAPSGLIATAAEREVQRRWDAPGGKVVPKPAPRS

SEQ ID NO: 4544 - protein, 505 aa, Mycobacterium paratuberculosis
MRVGIDFGTTHTVVAAVDRGNYPVVFFDGMDAWPSIIAANAAGELRYGADAAAVRHDPSWSVLRSFKRLLNDAGPQTRVKLAGRDYRLAELLTGFLARLKTDLQQHSNATVAPGEPIEAAISVPANASSAQRLLTLDAYVAAGFHVVALLNEPSAASLEYAHRYRSTITAKREYVLVYDLGGGTFDASLLKMTGHSNEVVVSEGIQRLGGDDFDEAIVELVRAGADLPGLDAAGRALLAEECAARKEAVGPQTRRFLVDLSPFDRPPFSCPVDDVYAACAPLVDPTMRLLERVLRDPSRGRADVDWSEVAGIYVVGGAGGFPLVSRMLRARFGDKRVKRSPHPFAATAIGLAVFLDKESGFALSERFSRNFGVFREAEAGAGVVFDPIVCKDVSLPADGQTPLVVKRRYRAAHNIGHFRFVECSRLVDGRPDGDITPYDPVLFPFDPALRDRDDLGRQPVGRWRDGPDVEERYVIAPSGAVEVTLTTQPAGFERTFRLERCASAS

SEQ ID NO: 4545 - protein, 318 aa, Mycobacterium paratuberculosis
MTKIGYFLSCEQFGPKELVDQAKRAQDAGFEALWISDHFHPWNDEQGQSPFVWSVIGALSEATSLPVSTAVTCPTIRIHPAIIAQAAATAAVQLQGRFVLGVGSGEALNEHILGDPWPSAGVRLQMLEEAVEVIRKLHQGGEVSHHGKHYEVQEARIYTRPEQPVPIYGSAFGPQAVRLAARIGDGYSISMPDGELVKQFREAGGGDKPVQGGTKVCWDADADAALKTAHRLWGNEGLPGQTSQILPRPKDFAALMPLVPPDTVAQSVACGPDPDRHIAQLRRYIDADIDEVYVQQIGPDMDGFFAAWEQAVLPAVRN

SEQ ID NO: 4546 - protein, 284 aa, Mycobacterium paratuberculosis
LDSRRRRRRDRRRRHGHRDHHRAGVTMPSMLELAAPGDGVRVLRLNRPHRLNAIDEAMQTELRLVLDDLAADHAVRAVVLTGAGRGFCAGIDMRDFGPSMVRADAPALERMRFQERMAALAEAVWALPQPVIAAVNGPCVGAGLALCLAADIRICSAAATFANAAILLGLSGAEMGMSYHLPRIVGTGVAADWMLTGRTVSAAEADRRGLVSEVVEPDRLAERAVELARLIAGHAPLGAQLTKRALQVNTDAASLASAMELENRNQVIAHATDEAAARRQMWSR

SEQ ID NO: 4547 - protein, 431 aa, Mycobacterium paratuberculosis
MSWDFSTEPQWARQLEWVEDFVREECEPIDLIVKESHDLDDPVRQALIPPLQKIVKERGLWATHLGPHLGGPGYGQVKLALLNEILGRSECAPIVFGSQAPDSGNSEILAHYGTPELKARYLEPLLDNRIVSCFSMTEPQGGADPKVFRTTAVPDGDHWVINGEKWFSSFASMASFIIVMAMTDPEAPPYQRYSMFVVPGDTPGITVLRDVGLGYQPLGGGREGYVRYENVRVPADHMLGPRGGAFVVAQTRLGGGRIHHAMRTVGLVRRIFDMICERAVSRYTQGEVLANKQLVQEMVADSWMEIEAFRLLTLQTAWKIDQFNDYRAVRADISAVKAMMQRVLHDVSARALQLHGSLGTTHEMPFVQYLVESFVLGLADGPTEVHKVTLARLLLKDRAPAPDLFPSEHLLRLRAAAEAKFADKLAGIPRG

SEQ ID NO: 4548 - protein, 220 aa, Mycobacterium paratuberculosis
VAAVCLALSLPTAPTTGADPDAAPPPPEAAPAAEGALPSNPPAILKTPDGWTLGLGARDEQQVPVAPLTTALSSREYLASGIFVGSLSGPTQPQGVLEVGYEIGCGIDMSTSDGVTIGGTAGITPGVTGPVTGVPGDVLPLVVAPIAGVLNVGLKPGLVIVVPVVKKQFRGPNPWVMVSNFHVKIDGCVGQSFIRSYAVLNRVTDESDVVLSYVGVTKAV

SEQ ID NO: 4549 - protein, 81 aa, Mycobacterium paratuberculosis
MTFRSCGRGLLAAAATAIALGCAAGAAHADPNVDPRPQPPGIDDVWSPFPTTWTNPSNEGQPVNDSGDVGMICENLLVRCQ

SEQ ID NO: 4550 - protein, 281 aa, Mycobacterium paratuberculosis
VVIKVAPPGVAPVAHRDVLRQARIIKALAPTDVPVPRVCWEDAGQAPYTPPLYVMSRVEGDCGEPLFDGWPAVPGLADRYRNACRTMAALHRISPTELGLGGEPVTDPVAEVHRWSDTLGTVDPALAPGWPKVRDALLDCAPRAMPPAVVHGDFRLGNLLADGPRINAVIDWEIWSIGDPRIDVGWFLINCDPDTYRRVTPPHGAVPSTAELADLYLHELGCDAGDLDWFSALACFKSAATWSLIVKHNRRRSSPRAELESMATTLPRLLDRAGALLARRR

SEQ ID NO: 4551 - protein, 268 aa, Mycobacterium paratuberculosis
MSGQRCDGMVALVTGSSRGLGRAIAGRLAARGATVALTARTLDPDPKYQGSLRQTRDEILAAGGKAVAVQADLSQPDERERLFAEVVDTVGAPDILVNNAAVTFLRPLDGFPQRRARLMMEMHVLGPLHLCQLAIPAMRERGRGWIVNLTSVGGDLPPGPPFSEFDRTAGFGIYGTAKAALNRLTKSLAAELYDDGIAVNAAAPSNPVATPGAGTLDLAKTDTEDIALITETVFRLCTGDPKTLTGRIAHTQPFLAEVGWPGTGPPVT

SEQ ID NO: 4552 - protein, 269 aa, Mycobacterium paratuberculosis
VLVCLPGGTYSREYWDLDIAGHDGYSFADFATGNGYAVLTVDPLGTGESSQPASDFGFAEIGAALDCALRALPGTTGVQAPAVAVAHSLGGYLALTQQALFGGYAAMAMLGCTNQHVAPLNLDPAFRARAATPQGRAELAAEILAALAQPYFAGPREHLQGWFHLADVPADIVAADAVTAVSVVPRVFGTAMIPGIVAEHAARIDVPVLLGYGVVDVSPDPRAEAALYRSSPDITTVVLAGSAHCHNMASSRHRLWRRLLAWAATAIDG

SEQ ID NO: 4553 - protein, 134 aa, Mycobacterium paratuberculosis
VPGTGHNLRFLSCPVHTYLYMRARGGVLTYLFLICAILAEVVATSLLKSTQGFTRLWPTVICLLGYAVSFALLAVSISRGMQTDVAYALWSAIGTALIVLIAVLFLGSPISVTKVVGVGLIIAGVVTLNLTGAH

SEQ ID NO: 4554 - protein, 473 aa, Mycobacterium paratuberculosis
VAGREVTSRFAGLALAPVAIALAMLFAPFAGADGYTDQLVARFDSQTHVVADPGARPPLQNPDGLNRQILAGPWRWSSGPPIWVAAVAPAQSGVTTADSIHEAMLRRDAQFSGVILVIDSRGYHVRAYHVPKVVADNVDEFMNQSAQDHRNDPYGAASEFVGKLSGVSVPTRAPVSTSPLVQQQRDDWAWLKAAFVIAGIALATAGLIWFAVSRNRKHRKDIENREQIKQELITAASNVGDLDNEVLTDGNTDVSAESLKANASLHDARKAYEKGDYGAARTHLRVVESTVAKANRKLHPGQREPEGAGADSSVPAPERKQASVRTTDPETGQTVTISNADYRPTAQPGYPHYFGGGYHNGIFFQPGFYPYPFWGPGWGWALGDVLLMDALLDDHWGGGFERGFEAGRDAAFADAGSHNAANYDAANYEAANYDGANYDGGYDAGGDIGFDGGWDSGAGWDSGGSDSGGDIGF

SEQ ID NO: 4555 - protein, 141 aa, Mycobacterium paratuberculosis
MSEAVYGLATVIALALASTLALVAAVHVHRLEGRATAPISEEIGSAKAVLHKVRKGEPMSPAEVDYAKQVVADRGSLMTLCIPGALFMLGCFFVFGSLYHLHGATPSERTFLGVIPMLTSTNLAIQIRRSARLRRRLRHLS

SEQ ID NO: 4556 - protein, 147 aa, Mycobacterium paratuberculosis
MSPRSTGRAVLARIWMPLVAVVAVGVGLLCMYKVHQFSEPEPVITVNGPQAPEQFNLKRITYEVFGSAGQGGKLVYVDIDGHPHQVDITTLPWTHTESTTLSVASGSISVHVHGGQVGCRMLVNDVVRDEQSGNHQDADVQCRVKSA

SEQ ID NO: 4557 - protein, 942 aa, Mycobacterium paratuberculosis
MTEHRLGASRVKRPLIPRMVRAFAIPIIFFWGLLAVTTNTFMPQVERVAEELAGPMVPHYAPSQRSLLHIGEKFHESNSTNLTMVVFEANRPLGDSDHLYYDDLMRRLQRDTKHVQYVMDLWGKPFTAAGAQSVDGRCTYVLLRLAGDIGQIQANQSVDAVRDIIKNDTPPPGLKVYVSGAAPLASDTLSIANASLNNVTIVTIILIVVMLLLVYRTPSTLLVPLLGVLIEMLVAKGITSTLGHLGYIELSSFAVNIVIALTLGAGTDYGIFLMGRYHEARQAGESREDSFYIAYRGVAPIIIGSGLTIAGACYCLTFARLNYFHTMGPAVAITMLFTIAAAMTLGPALLTVGSLFGMFDPRTDSKGRLYRRIGASVVRWPVPILVASSAIVMVGAIFVPTYRQNYDDRQYQPRNAPANLGFQAADRHFPKSKLFSEMLMIETDHDMRNSADFISLDRVAKALIRLHGVAMVQGMTRPLGRALEHASIPYLFTTQGSGNGQQLPFNREQNSNTDAQAEIQAHSVAVLRKEIGFFQKVSDELHQTVLTVEDLQRVSDEMNEEVSNLDDFFRPIKSYFYWEKHCFDIPLCWAFRSLWDTIDHIDHLAEDINQARISLTEVDKAFPQIIAQLKATADDTEALQLKLVNSYGSADLQSIQTDQTYDDLINVGNDFDRSRSDDYFYIPHEGFDNDDVKTGMKLMMSPDGKAARFIVTHEGDAMGPEGVEHVEQFPEAIKTILKETSLAGARIYIGGSGSNDKDIKQYAMSDLLIAAIAAFVLIFLIMLFITRSLVAALVIPGTVAFSYAGAFGLSILFWQHLIGLHLHWLVLPLTFIILVAVGSDYNLLLINRVKEELHGGIHTGLIRALGSTGGVVTSAGLVFAFTMLAMLTSELRTIGQVGSTVCIGLLLDTLIVRSFVVPSILRILGPWFWWPTLVRSRPLPQR

SEQ ID NO: 4558 - protein, 960 aa, Mycobacterium paratuberculosis
VTAPGAARPQKRAGSLRPGELAQASVMGALCAAIAIIAVVLPHGGGLGLLGSVPTGLLAYRYRIRVLITATVAAGVIGFLVVGLSGLAAIALCAYTGGLAGIVKRHRRGTPTVLAVSLVAAGVVGAGMVIALTVLTRLRQLAFHAIGAAVDGAASVVARVPPLHAAAVRFAEFFAAALQHWQWMVLGYALVAIVGASLVGWWALSRVLERLRGIPDVHKLDAPARNGPTRPVPVRLDRVRLRYPHADRDALRAVSLDVQAGEHVAVTGANGAGKTTLMLVLAGREPTSGTIERPGSVGLGELGGTAVVMQHPESQVLGTRVADDVVWGLPPGTTTDVGRLLGEVGLAGLADRDTGSLSGGELQRLAVAAALAREPALLIADEVTSMVDRQGREQLLTVLSGLTERHRTALVHITHYNDEAEYADRTINLGDTQGDTALIRTATAPAPTCPAGRGRRAPVLELAGVGHEYASGTPWSRTALRDVSFTVHEGDGLLIHGGNGSGKSTLAWIMAGLTVPTTGTCLLDGRPAAEQVGAVALQFQAARLQLMRSRVDLEVASAAGFSSDDRDRVSAALAAVGLDAGLAERRIDQLSGGQMRRVVLAGLLARSPRVLILDEPLAGLDAASQRGLVELLAERRRETGLTVVVISHDFAGLEQLCPRILHLRDGSLDANPVAARPDPVPVAPPTKRPAARRRPVVLLRPVPGSSPIHELWAGTKLLVVFAMSLLLTVFPGWVAVGLATALAAAGLRLAHIPRGVLPSVPRWLWIFLGVVGVTAALAGGAPTIRLGTASLGLGGLLDFLRATALTVVLLGLGALVSWTTNVAQIAPAVATLGRPLRVLRIPVDDWSVALALALRTFPMLIDEFRVLYAARRLRPRRPAQTRWARLRRPATDLIDVVVAVITVTLRRADEMGDAITARGGTGQISAAPSRPKRNDWIALSIASAVCAAAVAAELALLAGH

SEQ ID NO: 4559 - protein, 427 aa, Mycobacterium paratuberculosis
MVRIASVVARQLLDCKARPLVEVEITTDTGHVGRGAAPTGTSVGAHEAFVLRDGDPTRYRGRSVHRAVAAVRDEIAPALTGAELDDPRSLDRVMIELDDTPDKHRLGGNAIYSTSIALLRAAAAAAGTPTYTYVGALLGLTPPTTVPMPSFNMINGGRYGDVEQSFSEFLVVPYRAESIQAAVEKGVSLFEVLGEVLAEHLGRTPLLASSYGYIAPSGDPHAVLELLAEAVERAGCADVMAFALDCASSEVCDNGSATYAFNGGRVTAEALIDYARALSQEFPMLFIEDLLDGDDWAGFTKAVQTVNRSIIVGDDLIVTNRDRLRRAVETSAVDGFILMPNQVGTIAEALDCFEYASQNGLLAIPSGRSGGVIDDVVMDLAVGLGAPLQKNGAPRSGERIEKLNFLLRAAEGIPDCALADVPALARF

SEQ ID NO: 4560 - protein, 215 aa, Mycobacterium paratuberculosis
VGCCTGRRPTTRTRRERCCAPPCAVTSRSNSMAASDRHPQRLTPLPADEWDEDTRAALASLIPAERANPVGAGNVLSTLVRHPDLTAAYLPFNAYLLTRSTLSPRIREVALLRVVHRSKCGYLWSHHLPIARRAGLSESDIDDIRRGRCADPTDAAVVRAVDELTGDSTLSRQTWDRLCELFTQRQCMDLIFTIGGYLLLALAVNTFGVQEEETP

SEQ ID NO: 4561 - protein, 281 aa, Mycobacterium paratuberculosis
MSLLTITKLTDSVGAEVTGLDPAALAHDDSVGEAVLDALEDNGVLVFRGLYLDPAAQVAFCGRLGEVDHSSDGHHPVPGIYPITLDKSKNASAAYLKATFDWHIDGCTPLGDECPQKATVLSAVRVAERGGETEFANSYAAYDALTDDEKRRFGALRVVHSLEASQRRVYPDPSPELMARWRSRRTHEHPLVWTHRSGRKSLVLGASADYVVGMDVDEGRALLEELLQRATVPERVYRHGWSIGDTVIWDNRGVLHRAAPYDPDSSREMLRTTVRGDEPIQ

SEQ ID NO: 4562 - protein, 420 aa, Mycobacterium paratuberculosis
MTRSGRPPEGSWTEHYPELGTGPVSFKDSTSPEFYELEREAIFKRAWLNVARVEELPRVGSYLTKEIEAARTSVIVVKGRDERIRAFYNVCRHRGNKLVWNDFPGEETRGTCRQFTCKYHGWRYDLTGALKFVQQESEFFDLDPAEYGLRPVHCDVWNGFVFINFDPQPRQSLREFLGPMITGLDGYPFDKLTERYDWVAHNNSNWKIFADAFQEYYHVPALHSQQVPPEVRDSNAVFTCGHFQLDGPHRLVSTAGRRRWLMPPEYMYPIERATRSGLVGPWRTPDIGELPAGLNPGGIEQWGISNFQIFPNLEILIYGGWYLLYRYWPTSHNTHRFEAYTYFHPARSVRERIEHEVAAVVLKEFALQDAGMLGGTQAALEYGVVDDFPLNDQEILVRHLHKVVVDWVDAYRRERETVGV

SEQ ID NO: 4563 - protein, 246 aa, Mycobacterium paratuberculosis
MRVAVVTGGASGMGEATCHELGRRGMKIAVLDVNEHAAQRVTDDLRTDGATALAVGADVTDRAAVEQAFAKVRSELGPVTVLVTSAGMFGFSPFLDITAESWSRIIDVNLTGTFHCCQVALPDMVAANWGRIVMISSSSAQRGSPFAAHYAASKGAVITLTKSLAREYAPHGITVNNIPPSGIETPMQHQGQADGYLPSNEQIAANIPLGYLGTGADIAAAVGFLTSDEARYITGQVLGVNGGAVM

SEQ ID NO: 4564 - protein, 246 aa, Mycobacterium paratuberculosis; identical to SEQ ID NO: 4563

SEQ ID NO: 4565 - protein, 150 aa, Mycobacterium paratuberculosis
MELTDNILWLLKQAFYYSLTTINEAMREHGVSTAQIGVLRQLANEPGLSGAELARRLLISPQGVQLALTALERRGLVERKQDPQHARILQAYLTGEGRKVAETVVNDAIAAHQEVFGVLTEQEQQTLRELLGRVVEKGTGHELFTDHVDG

SEQ ID NO: 4566 - protein, 415 aa, Mycobacterium paratuberculosis
MTTVLRAARWADVVTGKIHAPAVIVVDDERISAMNPEGPLPDSATTVDLGDTTLLPGLMDMELNLLIGGPGGPEGLPSPMHGVQDDPAYRTLRGAVNARTTLEAGFTTVRNLGLMVKTGGYLLDVALQRAVDAGWHAGPRIYPAGHAVTPYGGHLDPTVFQRLAPGIMPLSVAEGIANGVPDVIACVRYQIRHGAKLIKVSASGGVMSHSTAPGAQQYSDAEFAAIADEAHRAGVRVAAHAVGDSAIQACIRAGIDCIEHGFLASDETIQMMVDHGTFLVSTTYLTEAMAIDRIAPELRKKALEVFPRAKAMLPKAIEAGVRIACGTDAPAIPHGQNAKELGALVQRGMTPAQAIRAATVVAAELIEADDELGRLAPGYLADIIAVPGNPFDDIAATLDVRFVMKNGQIYKTPAA

SEQ ID NO: 4567 - protein, 422 aa, Mycobacterium paratuberculosis
MARFPKPPEGSWTQHYPELGTAPVSYEDSINPEVYELEREAIFKRAWLNVARVEQLPRKGSYLTRELKVVNTSIILVRNGSGEIKAFHNVCRHRGNKLVWNDMPLEETRGVCRQFTCKYHAWRYDLDGNLTFVQQEEEFFDLDKSRYGLVPVHCDVWEGFVFVNFAKTPEQSLREFLGPMITALEGYPFDKMTSRWCYRSEVKANWKLYMDAFQEFYHAPVLHANQSPTAYSKAAAEAGFEAPHYRLDGPHRLVSTSGVRAWEMSPEMRKPIEDICRSGLFGPWDKPDLGPMPDGLNPAKCDPWGLDSFQLFPNFVILFWGQGWYLTYHYWPTSYHSHVFEGTLYFPVPRTPRERVAQELAAVSFKEYGLQDANTLEATQTMLESRVVDKFVLNDQEILLRHLHKETAAWIDDYRRMSTAGV

SEQ ID NO: 4568 - protein, 292 aa, Mycobacterium paratuberculosis
LILAREARMGHDAGVRTDGQGRRADVIRVISPHTEQPVAEVDAATPSDVDAAVAAARAAFDAGPWSRGGPSHRIAAIRRLADIYDRRRAEMADTITAEIGAPISFARRAQVGLPAFMIRAFCDLAERHPWQETRPGFFGSDVYVRREPVGVVAAIVPWNMPQFLIVTKLIPALLAGCTVVLKPAPESPLDALLLAEMISEADLPPGAVSVLPGDAALGAYLAGHRGVDKVSFTGSTAAGRAVAAACAANLTKVSLELGGKSAALVLDDAPPDKVAAGVRAASLSNSGQICMR

SEQ ID NO: 4569 - protein, 175 aa, Mycobacterium paratuberculosis
MSGLRVGDPADPDTDLGPLVSRRQQQRVRDYIRIGQQEGARLVVGGADMPDGLDRGWYVRPTLFAAAGNAMRIAREEIFGPVITVIPYRDDDEAVAIANDSDYGLAGSVWSDDTDRALALATRIHTGTVGVNQGYTMDPFAPFGGVKASGYGRELGPEGLDGYLDTKSIAVAASG

SEQ ID NO: 4570 - protein, 71 aa, Mycobacterium paratuberculosis
MVGVDRSRKAVIAPRAGAAVNSHRVLVAFLTVTVLISAIVGAIAAAAMGQPTAALLIALVAGGWFSAAVLC

SEQ ID NO: 4571 - protein, 127 aa, Mycobacterium paratuberculosis
VTEFLNLEDLLDIARAAVGTNVVVADYGLLESALARPRASAFGRDAYPDLHVKAAALLHSLARNHALVDGNKRLAWTACRTFLAINAHWIEAPEDERFDFVIGVATGALTSLDEIAERLRSWSYQED

SEQ ID NO: 4572 - protein, 412 aa, Mycobacterium paratuberculosis
LGERAPRPGPLPREVWILSWANVMVALGYGVISPALPTFARSFGVSIKAVTFLVTVFSLSRLCFAPISGLLTERLGERRIYIGGLLIVAVSTAACAFSQAYWQLMLYRVFSGVGSTMFYVSALGLMIHISPADARGRIAGLFTTSFMVGAVGGPAVGGLAAGWGLTAPFVVYGVAMLGVALVLFLGLRNSALAAPRPPTRSTVTMREALRVRAYRSALLSNFATGWSAFGLRMALVPLFVSDVIGRGIGTIGVVLAAFAGGNALAVVPSGYLSDRMGRRTLLIVGLVTSGAATVWLGFVASLPVFLVAAGVVGVVTGIYMSPLQAAVADILGNEARAGLPVATVQMMSDLGAIVGSMAVGWAAEQIGYGWGFFISGVVLLIAAVGWVMAPETRTATELEADLMAAESDVEPV

SEQ ID NO: 4573 - protein, 547 aa, Mycobacterium paratuberculosis
MVANSRAGQPAQPEDLVDLPHLVTAYYSIQPDPGDVAQQVAFGTSGHRGSALAGAFNEAHILAITQAIVEYRAAHGISGPLFIGRDTHGLSEPAWVSALEVLAANDVVVMIDSRDRYTPTPAVSHAILSYNRGRTEALADGIVVTPSHNPPSDGGFKYNPPNGGPADSDVTNAIAKRANEILRDGAGVKRVPLARARRAAQRHDYLGNYVDDLPNVVDIDAIRSAGVRIGADPLGGASVDYWGEIAERHNLDLTVVNPLVDATWRFMTLDHDGKIRMDCSSPDAMAGLIRTVTAEPGRFQIATGNDADSDRHGIVTPDGGLLNPNHYLAVAIEYLYTQRPSWPGGIAVGKTAVSSSMIDRVVAGLGRKLIEVPVGFKWFVDGLIGGTLGFGGEESAGASFLRRDGSVWTTDKDGIILALLASEILAVTGSSPSQRYQRLTAQYGTPCYARVDAPADRDQKARLSKLSAEQVTATELAGEPITAKLTAAPGNDAPLGGLKVTTANAWFAARPSGTEDVYKIYAESFHGPQHLAEVQETAREVVNKVIG

SEQ ID NO: 4574 - protein, 132 aa, Mycobacterium paratuberculosis
VAQHDYRELAAVFAGGALGSLARAALSALAAGDPASWPWPTFTVNIVGAFLVGYFTTRLLERLPTSSYRRPLLGTGFCGGLTTFSTMQVETLTMLEHHHWGLAAGYTLTSIAAGLLAVHLATKLVRRVRVRR

SEQ ID NO: 4575 - protein, 122 aa, Mycobacterium paratuberculosis
MTTVAVWVGVALIGGVGSVLRFVVDGAVARRASRPFPLGTLVVNLSGAALLGFLGGLALSREAALLAGTAFVGAYTTFSTWMLETQRLGEERQLRAALANIVVSVVLGGAAAFIGQQLAQLV

SEQ ID NO: 4576 - protein, 208 aa, Mycobacterium paratuberculosis
MSGVEPILPRELTNVPEEIRGVPAPPVPALPQPYGLRVVDPDADAETVCEWMSRPHLVQAWESNWPLARWRRYLRAQLDGEFSRPLIATLDGVDRAYLELYRAAKDSIATRYEHHPHDLGLHVAVADLDHIERGHVSYLLPHLVVSLFSLDPRCRRIMFDPDHRNVLARKFCERSGCTFLGEHDMANRRMALYVLPRTPDDVPRRRDA

SEQ ID NO: 4577 - protein, 118 aa, Mycobacterium paratuberculosis
VSAGRRIQVARVYDKVGPDEGQRVLVDRIWPRGVRKDDPRVGIWCKDVAPSKQLREWYHHEPERFDEFTSRYKSELRGNPALDELRTLAKRGSVTLVTATRDLDISQAVVLAELLKSG

SEQ ID NO: 4578 - protein, 381 aa, Mycobacterium paratuberculosis
MIEHVFESLMAVDPAAGESALIERISELEMLKCAAAAAQARAAAALDAARRAAEAAAGVPAARRGRGVASEVALARRDSPARGGRHLGFAKALVHEMPHTLAALECGALSEWRATLIVRESACLDAEDRRALDAELCADPAGLSGMGDARGGRGRQGDRLPARSACRRGAGGQGGERPHGHHPARARHDDVPDRVIARGPRCFGVCRAAPRGRHPRRRAPARTGHGRHPGGKGHRPPRDGAHPGRGQPGAVRRNAARRCGCAGRDQWLRPDSRGGRPPHGRQRGRRPEVAGHPAPALRAPAGRGAGGHGVAGAPVPAGAGAVHRATRSALPHPVLRRADPAPRPRTAVGRRRRDQRGQRPGAVRALQLRQGNARLDGERRR

SEQ ID NO: 4579 - protein, 381 aa, Mycobacterium paratuberculosis; identical to SEQ ID NO: 4578

SEQ ID NO: 4580 - protein, 306 aa, Mycobacterium paratuberculosis
MYEQVNSSAAEPDDIGSRIDPVLARSWLLVNGTHPDRFQSAVNSRADIVVFDIEDAVAPKDKNAARDNVVSWLRAGNVDWVRINGFGTPWWADDLTALAGTPVGGVMLAMVESVDHVTETAKRLPDVPIVALVETARGLERITEIAATKGTFRLAFGIGDFRRDTGFGEDPATLAYTRSRFTIASKAADLPSAIDGPTIGSNPLKLIEATAVSTQFGMTGKICLTPDQCSVVNEGLSPSQDEIAWAKEFFAEFERDGGEIRNGSDLPRIARATKILELARAYGIEALDIDEEERDHSPAPSDTYHY

SEQ ID NO: 4581 - protein, 187 aa, Mycobacterium paratuberculosis
MADMIVKSPDEVVAFLKAQHNLIEDMFDQVLHATDPKAREEPFATLRQLLAVHETAEEMLVHPPARKEADAGDAVVDARLHEEHSAKELLSAIEKLDSTTDQFLDEVTKLREAVLEHATREENEEFPALQRLDSDDLKRMGTAVRAAEAIAPTHPDPGVESATLNFAVGPFASMLDRARDLIGRAIG

SEQ ID NO: 4582 - protein, 491 aa, Mycobacterium paratuberculosis
MSVAPETTVALQDRFFRELPELAVRWQAETFPELRLLVLNEPLATQLGLDTGWLRGPDGLRFLTGNLVPTGAAPVAQAYSGHQFGGFVPRLGDGRALLLGELVDNKGRLRDIHLKGSGATPFARGGDGLAAVGPMLREYVVSEAMHALGVPTTRSLAVVGTGRPVYREATLPGAVLARVASSHLRVGSFQYAAATGNRDLLRRLADHAIARHHPGAADAEQPYLALFEAVVAAQASLIAQWMLIGFVHGVMNTDNMTISGETIDYGPCAFMEAYDPDTVFSSIDFWGRYAYGNQPVIAGWNLARFAETLLPLFSENTEEAIALAERSFGVFQTRYDAVWATGMRAKLGLPAQVDAEFAAALIDELLALLKANHVDYTSFFRQLGRAARGDDRSAAEPAREMFMDLPGFDAWLARWRALGPDADAMDRVNPIYIPRNHLVEEALAAATDGDLDPLDQLLAAVTAPYTERPGFERYASPAPEDFGKYQTFCGT

SEQ ID NO: 4583 - protein, 90 aa, Mycobacterium paratuberculosis
MARIDNAMDPVRRVLRHQISVGALIELAVWLAIPYLCIGFAWTVFHADQTHRIQARIEAVWPAGADVAAFGVATALWPASLQIADACRTP

SEQ ID NO: 4584 - protein, 198 aa, Mycobacterium paratuberculosis
MSSPSRWAGVPLKDRRAERRALLVEAAYRLFGSGGEAAVSVRSVCRECGLNTRYFYESFRDTDDLLGAVYDRVSEQLEEVIAAAIEQAGDSLRARTRAGIAAVLGFSSADPRRGRVLFTDARTNPVLAARRRATQDMLRQGVLSEGWRLNPRSDPVAAEVAAAMYTGAMAELAQQWLAGHLGGDLDAVVDYASKLVLR

SEQ ID NO: 4585 - protein, 334 aa, Mycobacterium paratuberculosis
VFLPHQIIGQLINKQLDDNMRRYFFRGMEFAAPVGDPGWFGPDSAVWRVHSHLPALIFGLQCAAFMETLDPSIYWMGMHHSRLIKRDSNGNPVSHVPVIDPEGAATRLGHSVAFFIGTAYGSPETAERLAKSVRAMHHTIKGTRPDGARYDADDPEWLRWNYATVVWGIATAHELYHPMPLRGKALDRYYGEFVRVGHALGGTDLPATKAETLECLESYLPKLAVTHGKAMGTGPNVAMPQAAVDWAIRDTMPKWAKQMLQHRDCNIIERTARRSAVWAIINGIHAASGPAPEFRQAQARVRGGTTVPHTVPSYVLGTDQVRSRAEVERSFQSV

SEQ ID NO: 4586 - protein, 131 aa, Mycobacterium paratuberculosis
VYHTRAGGRDASAARLYEDEAMRMLALLAGFAALAGMAAPAHADPAGTTGSDASFLAALNQAGITYQNPATAIEVGKRACELMDQGSPQVEVIKNVSSSNPGFTVDGAAQFTMIAASAYCPQHLGQRVGPG

SEQ ID NO: 4587 - protein, 426 aa, Mycobacterium paratuberculosis
TFERGDKTLPGPNQLGAFLFWMVRKRPALQIHLLKSNLRLLPALDGLWFGLTPVSLLNQISSRRMHFAIDGAHPVGSVHHQKIVVVDDAVAFCGGIDLTLDRWDTRAHEHTSRRRRTAGRGYGPRHDVGVAVDGAAARALGEQARTRWQTATKQSLSPVTAKHSAWPSKLRPTLRNVDVGIALTLPDLDDRPEVRQVEALNLAAIAAARDTIYVENQYLASRTIAQALAQRLREEHGPQIVIVLARKGNNPLERGTMDSARHRLIRLLWDADEHHRLGVYWPVTDGGAPIYIHSKVLAVDDRLLRIGSSNFNNRSMGFDSECDVAIEARGSQHDDVRREITSVRNELVAEHLGVPVATLQEAIADRGSLLAAVEELRGDGKTLRPFTERTVANEAGPLAENELMDPDHVPRSLTRSVQRLITGRRG

SEQ ID NO: 4588 - protein, 277 aa, Mycobacterium paratuberculosis
LEDLRGDLAQRYKRTPTGGSSVDSAIVGADMAALDRDGYVIWENLLSTEQCAQIRETVRPWLGHTGRNSFEGRRTQRVYSVLSRTRMCDRLVDHPRVLAVLDRLLMPNYLLSALQAINIQPGEAAQLAHHDDGFYPVPRPRAPLAAATIWAIDDFTADNGATVLYPGSHRWGKRRPGPDDEAIPVVMPAGSCVLFVGTLWHGGGANTTDRDRLAVTAQYCQPWLRPMEAFTLSVPRDIARTVSDDIRRMLGYSIHPPFVGAVDGLHPLRLLEMEPDA

SEQ ID NO: 4589 - protein, 254 aa, Mycobacterium paratuberculosis
VQHHVFGPLDMHDTRYLPPAKACGPHIIRGAAIAWAPNGEPTTECPEWTWRTTLLPRIAPTARDEESRDDPSKNPDYYALLRGTVHDPTARRMGGVAGNAGVFSTAHDVGVYAQALLDRLAGRPSDFPLQQGTVELMTTPQQPGHDPRQLEAANRAARSGTPNYPAIKGQNLFGFGWDIDTGYSRPRGRVFPIGSFGNTGFTGTTLWMDPGSDTYVILLSNSIHLRGSPPISNLRGDVATAAARALHLYGAAPP

SEQ ID NO: 4590 - protein, 190 aa, Mycobacterium paratuberculosis
MPGHPSVRNVLVLATILLTLVAASSTGRVVHTSPSEAPPASMTPHASLVPESTSPAEDFTTISKLVNDAIAARGLPGAVVMVGHGGKVVFHQAYGSRKLAGEPGLDGAPAPAEPMTEDTIFDLASLTKCLATAVAVMQLYEQGKVAFDDPVQKYLPDFNTTNDPQRTKVTIRMLLTNTSGEGIDVSLRDP

SEQ ID NO: 4591 - protein, 232 aa, Mycobacterium paratuberculosis
VGAAAQGGNKRAGAPSLLPGGRWAAVLAGAVMLAQCTASSAAADPTVRPVTAAELGASWHPGCPVEPGQLRRVDVDHIGFDGQTHRGELIVHQDLAPQVVTIFARLYRLGFPIEKIRTVDHYRDADDELSMEDDNTSAFNCRGIPGSDRWSEHAYGRAIDLNPRLNPCLYPTGAFQPQNARGLSGPRPHRPGPAARRRPGRARLHRQRVALGWTVDGARRLPAFRAALKQPR

SEQ ID NO: 4592 - protein, 167 aa, Mycobacterium paratuberculosis
MSRSIDVSTESPASVEQIHAAFGREDYWLARIAPAATTTLDSLVVDGDGTVTVRVTQHLGRQLLPGAVAKFVRGDVKIVQTETWRRDGDGQVRGQVDVSASGGLGSGRAESWLEPAEDGGSRLRSAVRVEVKIPLVGRKLEKTIGADLAKGIPEMLRFTTTWIDENA

SEQ ID NO: 4593 - protein, 388 aa, Mycobacterium paratuberculosis
MRFALATMGTRGDVEPFATIGRELQRRGHEIRMAVPPNYIRFVESAGLSAVPHGPDQVKQNEDIVRKYGTAPNPMFLAWVISEDLKRLWPSLGTALMSLADGADLLLTDTSEHGLAANVAEYYDIPAATLHYYPSGGAAQLTQEAESAQRRALGLSGPTAPAARRPMELQAYDEFFFPGLAAEWAQCGVRRPFVGALTLELPTEADDEVLSWIAAGTPPIYFGFGSSARVASPGDVIAMITTACAELGERALICSGVSDLTQIRTGDHVKAVSAVNHSTVFPACRAVVHHGGPGTTFAGIRAGVPSLVLAVSVDQPLWAAVINQLEVGIGRHFSETTPDSLVADLRSVLDPRYVTRTRAVAARMRTPAESASAAADVLEDAARQGSCG

SEQ ID NO: 4594 - protein, 241 aa, Mycobacterium paratuberculosis
MTDPLWTAYAEKVDKVDGWFFEADVELFSHLLARQTAEGISGDMLEIGTYQGKSAILMGYGLRDDEELVICDLFEAVVDHTHGSPSSRDQYSGLDQQQFLANWDRFHTRRPMIEVCESSQLDLADRAVRLAHIDGCHAYPCVAHDIELAVRHTADRGVVVLDDYRGVETPGVAAAVWQAVGNGVLFPFAATYMKLYACASPADQHYWLEQVRGRGDICAFPDFEFPSYRSISEAQLRPLDR

SEQ ID NO: 4595 - protein, 158 aa, Mycobacterium paratuberculosis
MVVRGPSVSGTLRLVKLTRDTDRALDDRSAQLQTEIDQLSEKLGVRPMLVGLRTNDGLNVYVANDGSYHFTFYERGQLGFDRVGNLDDLLYWYTQSVVTGQAAKSVGDRAERFKYEYQVLSALNSEWAKRNVRETAELFRRYGQPEDISLLPDIGEPL

SEQ ID NO: 4596 - protein, 283 aa, Mycobacterium paratuberculosis
VTMADRLVTKVDKSAVLAGLFAVWDDIDALLAGLSETQWRAPSPLPGWDVKAVVSHMIGTESFLAGIAAPEPDVDVSALEHVRNDIGAMNECWVRHLSAHADADVLESFRAITDDRRAALTSMSDEEWDAVTMTPTSPDSHGRFMRIRVFDCWMHEQDIRVALGRPPSDADLAGPAASLAVDEIAATMGYVVGKLAKAPQGARVEFELTGPLARVIRVSVDGRATVVDDFAGEQATATIRCDGLQFTRLAGGRPMCPARDQTVELGGDKGLASHVVARLNFVI

SEQ ID NO: 4597 - protein, 261 aa, Mycobacterium paratuberculosis
VGGVAARRVAALRVMLVAYPIETLLLGALAIFVGGPIHPGALLWGGLYGIGMAFGMWAFFAALGSGPISVVSPLAAVLNAAVPVAVGMALGERPGQAALVGVVLALAAVMLVSREAPAEGTPYRFTPKVAWLTVVAGSAMGLNLVFLHQAPHACKLWPLVFARVAASLVVFAMAGTSQNLKMPRGRPLRLAVAVAVLDIFANITMLAALHTWLLSLASILISLYPAATVVLAMVVLRERVTRWQGIGMVLAMGSVAMIASA

SEQ ID NO: 4598 - protein, 169 aa, Mycobacterium paratuberculosis
VAKGSGRAKAAGGKGGSKQIIATNRKARHNYSIIETYEAGVALQGTEVKSLREGQASLADAFATIDDGEVWLRNLYIPEYQHGSWTNHDPRRNRKLLLHRQQIDRLVGKIRDGNLALMPLSLYFSEGKVKVELALARGKKAYDKRQDLAQRDAQREVVRQLGRRTKGMI

SEQ ID NO: 4599 - protein, 297 aa, Mycobacterium paratuberculosis
VRFGFLLNEVLTGLRRNVTMTAAMILTTAISIGLFGGGLLVVRLADNSREIYLDRVETQVFLTDDISTNDATCGSAPCKALRDKIDARQDVKSVRFVNRQDAYNDAIKKFPEFKDVAGKDSFPASFIVKLNNPEQHAEFDAAMQGQPGVRSLLNEKDLIDRLFAVLDGLRNAAFAVALVQAVGAILLIANMVQVAAHTRRTEIGIMRLVGASRWYTQLPFLVEAMLAAAIGVAIAVVGLILVRAWFLDNALSQFYQAHLIAKVDYADILYISPWLFVLGVSIAGLTAYATLRLYIRR

SEQ ID NO: 4600 - protein, 229 aa, Mycobacterium paratuberculosis
MITLDHVTKKYKASARPALEDVNVKIDKGEFVFLIGPSGSGKSTFMRLLLGEENPTTGDIRVSKFHVNKLRGRHIPKLRQVIGTVFQDFRLLQQKTVYENVAFALEVIGKRTDAINRVVPEVLETVGLSGKANRLPHELSGGEQQRVAIARAFVNRPLVLLADEPTGNLDPDTSKDIMDLLERINRTGTTVLMATHDHHIVDSMRQRVVELSLGRLVRDEQRGIYGMDR

SEQ ID NO: 4601 - protein, 166 aa, Mycobacterium paratuberculosis
LKFTLNILEKRGSDDDTEAEHRWPQYVFGGRMRTSTFVLIVAFLLVWWVYDTYRPEPAPKPPAQQVVPPGFVPDPNYTWVPRSRLQQPPATVTYTPTPTSTPPPPPPPPPVTTTTTTTTTPPFQLPKLPCILPAPFCPPSTTPSTPAPEQPQPGPGPTPTSPPPAS

SEQ ID NO: 4602 - protein, 331 aa, Mycobacterium paratuberculosis
MTNNTSVLAGAMTTAAHRWHDFWRGELGEWIITRGLRIVMVLIAAVLAARFVNWVALQVSRQPTTGFVESDALVRSEASKHRQAVASVISWVSVVIIGIWVMLQIASILQFSVGGLVAPATVVGAALGFGAQQLVKDLLSGFFILAERQYGFGDLVTLTVVAATEASGTVENVTLRVTRLRSPDGEVLTIPNGQIVKVVNLSKDWARAVVDIPVSTSADLNRVNEVLHQECDRAMDNPVLGQLLLDSPTVMGVESIEVDTVTLRLVARTLPGKQFEVGRQLRVLVIRALARAGIVTAADARVGLVEDASVPAAQAAEQQSDDDVQGAVQKR

SEQ ID NO: 4603 - protein, 373 aa, Mycobacterium paratuberculosis
LSAVEPDRQADIAALDSTLTTVERVLDVDGLRARIEKLEHEASDPQLWDDQARAQRVTSELSHAQGELRRIEELRARLDDLPVLYELAAEDGEGAAEALAEADAELKALRADIEATEVRTLLSGEYDEREALVTIRSGAGGVDAADWAEMLMRMYIRWAEQHKYPVEVFDTSYAEEAGIKSATFAVHAPFAYGTLSVEQGTHRLVRISPFDNQSRRQTSFAEVEVLPVVETTDHIDIPEGDVRVDVYRSSGPGGQSVNTTDSAVRLTHIPTGIVVTCQNEKSQLQNKISAMRVLQAKLLERKRSEERAELDALKGEGGSSWGNQMRSYVLHPYQMVKDLRTEYEVGNPAAVLDGDIDGFLEAGIRWRNRKDDE

SEQ ID NO: 4604 - protein, 455 aa, Mycobacterium paratuberculosis
MRPYHVAIVGSGPSGFFAAASLLKAADGSEHPDVAVDMLEMLPTPWGLVRSGVAPDHPKIKSISKQFEKTAADPRFRFFGNVSVGEHVQASELAERYDAVIYAVGAQSDRALNIPGEDLPGSIAAVDFVGWYNAHPNFEEATPDLSGSRAVVVGNGNVALDVARILVTDPDVLGLTDIADHALESLRPCGVDEVVVIGRRGPLQTAFTTLELRELGELDNVDVIVDPAQLEGVTDEDAAAAGKTAKQNISVLRDYAKRSPRPGHRRIVLRFMTSPIEIKGDGRVESIVLGRNELVTDETGRVSARDTGEREELPVQLVVRSVGYRGVPTPGLPFDEKTATIPNTGGRVEGSRNEYVVGWIKRGPTGVIGTNKKDSQDTVDTLLADLANAGPDGLADFPDDHADRLADWLASRQPKLVTTAHWELIDAHERAAGEARGRPRVKLPSLAKLLRVSHG

SEQ ID NO: 4605 - protein, 151 aa, Mycobacterium paratuberculosis
VILRSFEGVGSDEPVQVLSEDENWRLLGSVALGRLVTNFAGEAEIFPVNFVVQDRTVLFRTAEGTKLFSAVANHAVVFEVDDHNLVEGWSVIVRGRARLLKTDTDIQRAERAQLLPWTATLKPHYVRITPTEVTGRRFRFGPEPDRHEPVA

SEQ ID NO: 4606 - protein, 154 aa, Mycobacterium paratuberculosis
LVSGLTMPDLRDRADVEALLRRFYGRALDDEVLAEPFARLRATGLDDHVPTMCDFWETVLFRAGRYRGSALQAHRDIHRRTPLSDRHFRRWLTLWHNTVDEMYRGPAADRAKIQAARIAWAMHRRLTGADSPELLVTQRVRDDRAPDRTGSDDR

SEQ ID NO: 4607 - protein, 266 aa, Mycobacterium paratuberculosis
VAKRPTNRPVKEVAMSTAYPAPAIVVGVDGSRAAMHAAVWAIDEAVGRDIPLRLVYVIDPHGAPGGHGPDTRLAAARAALADAHRAVDAFAQPVKVETEILWGNTAFKLLEQSRSAVMLCVGQIGLNHACHGGPAIATSLVRSALCPVAVVQQAPSLPAAARVSGVVAEVDNGTVLRHAFEEARLRGVGLCAVGNPSARVELERRLARWMRLYPDVQAESAVLTGGVEQHLRADHRAGRLLVTDAYRAEALCHAGHSVLAVRCGNL

SEQ ID NO: 4608 - protein, 174 aa, Mycobacterium paratuberculosis
MTAPETSAQQTSSQPLVSRGWIQGVALVMIFGFLVMGILAYRTYSASMPMPDKVVSESGRLLFTGADITRGQELYQARGLMEYGSVLGHGAYLGPDYTAEYLRTATQDVADQLRAQGVADPRERVVTEFRTNRYHPDTKTLVFTDRQAAAFDHIQDRYGAYFGENSTKYGCCRT

SEQ ID NO: 4609 - protein, 551 aa, Mycobacterium paratuberculosis
VIVWSALSLVALLGGIGVMFAVYGRWSQKVGWHSAETSTLSFRQPGDVGLTPAQRACVWFFAIVSVLFLAQTLLGAAAEHYRADLSNFFGLDLARVLPYNLARTWHLQLSLFWTAAAFLAGGIFLVPFIARREPKRQALLAYILLGAVAVVVFGSLICEALSIYGVIPAGGLFSQQWEYLDLPRLWQILLIAGMFMWIAIIWRGIRGRLKGESKMNMPWLFFFSGLAIPAFYTVGLLAGSDAHYTVADFWRFWVVHLWVEDFLELFTTVMVAYMFVLLGVVREKIALGVIFLDVILYSAGGVIGTMHHLYFSGTPVEHMALGAFFSAAEVIPLTFLTVEAWAFLQLGARQQSGDANPFPHRWAVMFLVAVGFWNFLGAGIFGFLINLPVVSYYQIGTALTANHGHAAMMGVYGMLAVGLAMFAFRYVIPADKWPEKLARISFWCMNIGLAWMVFATLLPLGVLQLYHSVNDGYFEARSLGYITKPGNAVLEWLRLPGDVILIAGGVLPFVWIAWTALRNFRSGTTVQELPEHPLYTESPVMSEAGAAAAKD

SEQ ID NO: 4610 - protein, 208 aa, Mycobacterium paratuberculosis
VGAPATTVWLIAGYSLALLVVGWGFDVMARRASAHAARWRTGRFTYRPDHDAWICPQDHWLWPTSFDPKHRVMRYRALPVVCNSCPVKAECTTSEHGREISREVDPWPHSDAGRFHRGIACCVAGLGIVLPLATLVTNHSAADALVLTATVLLVALLGLPLARHLWNTPSNAPQHLPHRTAIEDQVAAAIDRYSTRWGGWKSKEDNAT

SEQ ID NO: 4611 - protein, 265 aa, Mycobacterium paratuberculosis
MTTLVIALIGAGIVVLVVLGFWSLVVLREYERGVVFRMGHVRPLYGPGLRFLIPLLDKMIRVDQRLVTLTIPPQEVITRDNVPARVNAVVMFQVTDPRKAILAVENYAVATSQIAQTTLRSLLGRADLDTLLAHREDLNNDLRTIIDKQTEPWGVQVHVVEIKDVEIPESMQRAMAREAEAERERRAKVINARGELQASEELREAAETLSKSPASLQLRYLQTLLELGADQNSTVVFPLPVDIITPFLRNPGLLQGVVDNVGRPG

SEQ ID NO: 4612 - protein, 391 aa, Mycobacterium paratuberculosis
MDWAFLPPEINSARMYTGAGAASLLAAAGSWDALSAELTATADGYESVLSGLGLQWHGPAADAMAFAAARYLTWLRATAEQTKQTAMQARTAAAAYEQAYAMTVPPPVIAANRTLLASLVATNIMGQNTAAIADTEAQYADFWAQDTAAMAGYSASSTAATQLPRFASANNSTNESGVTAQNAAVTAANANAAANKAVTQSFSPLADNPPGTTINNYYVDASSTSAANSNAFRVLDVIQGTGLGFSAPYNMEQFVSGIIGAENNLGMLAKPGAAAANIAPALAAPALRGATAGLGGGLGGGLGNVTATLSHAGTIGPMSVPATWSAPTSTHVSPLAPAGFTTLPGTEEPMASGYPGYPGMPGGGAARSAGAGVPPRYGVRLTVMPRPPAAG

SEQ ID NO: 4613 - protein, 362 aa, Mycobacterium paratuberculosis
MDFGFLPPEVNSARMYAGPGSGSLLAAAGSWDSLAAELSITAAVYESVLAGLTGLYWHGPASRAMAAGAAPYVGWLHTTAERAQQTATQARAAAAAYELAHAMTVPPAAVAANRTQLAALVATNFFGQNTAAIAATEAQYAEYWAQDAAAMYAYSASSAAAAQFSPFPSPRRTTDPGGVTAQQAAVAAAETGSTGTDSGAQVIPPTAGASEIPLDFRILDTILGAQTTFRSIFTTEGIPAGIIQADKNLGILPNLATVPAALPRTPALSASPSGLGRIDAVLARAARIGPMSVPAGWTAATGNPVAAAPVTGWSEPSAADARPGVTAPGLPGIPGATLRRAALVVPRYGVRITVMARPPAAG

SEQ ID NO: 4614 - protein, 107 aa, Mycobacterium paratuberculosis
VLLVAVLAVFLVQRFVPRGPRGELLSGTLLVTGVSPRPEATGEQYVTIAGVINGPTVNEHAVYQRMAVDVNQWPTIGQLFPVLYSSKNPDNWRFAPPAPPEPSQPGG

SEQ ID NO: 4615 - protein, 259 aa, Mycobacterium paratuberculosis
VSNDDLALALLLADRADAVTSARFGALDLRIDTKPDLTPVTDADRAAEAELRAVLARQRPNDSIVGEEFGGDTVFTGRQWIIDPIDGTKNFVRGVPVWATLIALLHDGVPVVGAVSAPALARRWWAAHGRGAFVAVNGAAARRLSVSSVAQLDSASLSFSSLSGWAQLGLRDRFLALTDAVWRVRAFGDFLSYCLVAEGAVDIAAEPEVSVWDLAALDILVREAGGTLTGLDGTPGPHRGSAVASNGLLQRQVLERLAL

SEQ ID NO: 4616 - protein, 463 aa, Mycobacterium paratuberculosis
MTDSGSTKTPARVKRRDRQSGVGLQPHKRTGIDIAIALLTPLVGQEFLDKYHLRDPLNRGLRYGTKTIFSTGAATSRQFKRVQNLRGGPTRLKSSGKDYFDLTPDDEQKMIVETLDEFAAEVLRPAAHDADEAATYPRDLIAKAAELGITAINIPEDFDGIAAHRSSVTNVLVAEALAYGDMGLALPLLAPGGVASALTHWGSAEQQATYLPEFAGENVPQACVAIAEPQPLFDPTRLKTTAVRTPSGYRLDGVKSLVPAAADAELFIVGAQLDGKPALFIVESSTKGLTVKADPSMGIRAAELGHVELSGVTVPLGARLGEDEATDDDYSEAIALSRLGWAALTVGTSHAVLDYVVPYVKEREAFGEPIARRQAVAFMCANIAIELDGLRLITWRGAARAEQGLPFAREAALAKRLGADKGMQIGSDGVQLLGGHGYTKEHPVERWYRDLRAIGVAEGVVVI

SEQ ID NO: 4617 - protein, 401 aa, Mycobacterium paratuberculosis
MAINLELPRKMQAVTTKTHQGAAELMRPIARKYDLKEHAYPVELDTLISLFEGASESIEFAGANALGGEDEERDKNHNGANMAALLQTLEASWGDLAMMLSVPYQGLGNAAISAVANDEQLQRLGKVWAAMAITEPGFGSDSAAVSTTATLDGDEYVINGEKIFVTAGSRATHIVVWATLDKSKGRPAIKSFIVPRDHPGVTVERLEKKLGIKGSDTAAVRFDNVRIPKENLLGNPEIEEGKGFSGVMETFDNTRPIVAAMAVGVARAALEEIRKILTDAGVEISYDKPAHVQSAAAAEFLRMEADWESAYLLSLRAAWQADNEIPNSKEASMSKAKAGRMATDVTLKTVELAGTAGYSEQSLLEKWARDSKILDIFEGTQQIQQLVVARRLLGLSSAELK

SEQ ID NO: 4618 - protein, 323 aa, Mycobacterium paratuberculosis
MRAARVTRLDGPDAIEVTDVDEPTGDGVFVDVHAAGVAFPDALLTRGLYQYRPELPFVLGAEIAGVVRSAPEGAHVRSGDRVVGLTMLSGGMAEVAVLAPDRVFKLPDKVSFEAGAGLLFNDLTVYFALTVRGRLQRGETVLVHGAAGGIGTSALRLAPALGAARTIAVVSTTDKADIATAAGATDVVLADGFKDAVKELTHGRGVDIVVDPVGGDRFTDSLRSLAPGGRLLVVGFTGGEIPTVKVNRLLLNNIDVVGVGWGAWTGTHPGALAEQWAGLERLLTSGELAPPEPVVYPLDEAAAAVASLENRTAKGKVVLRVRG

SEQ ID NO: 4619 - protein, 381 aa, Mycobacterium paratuberculosis
MSLSVFAAELGPTGGATMESFIHLRKGRTPGRLHADLDGLKDDELGRGGFTGRTANMYRRHDPTAYRVQGPLRPIDVLTSELKPSDASDANGGPLLMFANPDCRISLSRRSEPMPFYVRHVDGDLLCFVHGGAGLLHTEFGPMPYRQGDWVYLPKATTWRQLPDAETTLLMIEATDEFRVPPPGPLGRHFPFDPSQATIPEPQALDDDPAHDEYEVRLVHEGGPTTLFYQHNPLDVEGWRGDNFAFTFNIADYNVVTSDSVHLPPTVHLFMQATGVYVMNFLPKPAEGVPGTERTPWYHRNVDYDEIAFFHGGSLYGIPMPPGLISHAPQGVHHGAPEKARERARRKFDEYARVDWQVIAVDTRRRLTPSAEVLAHDLGQH

SEQ ID NO: 4620 - protein, 391 aa, Mycobacterium paratuberculosis
MKHEYDRIPYLVAFQNNSGVRDVYGGLAEITVLESYLLKPKNKPSDTVLVFMHPIGGGAYLPMINALARAGHHVIYCNSRFRGTDSALLMEKVVEDLGECIKDAKKRLGYTKVVLAGWSGGGSLSVFYQQQAQNPTITSSPSGDGPDLTKLDLTPADGIMLLAAHISRHGTLTEWLDASILDESDPTKRDPELDLYDSDNPNQPPYSQEFLDRYRQAQIERNRRITAWVKAKLAELKAAGRPDDEFGFVVHGTMADPRWLDPTVDPNERTPGTCYLGDPRVVNMSPVGLARFCTLRGWLSQWSYDDARGDALACGPDIAIPALVIGNLADDACTPSHTRRLFQAIGHHDKEMHEIPGATHYYAGPDQRDALRSAVGIVTDWLVRHDFAEKA

SEQ ID NO: 4621 - protein, 404 aa, Mycobacterium paratuberculosis
MSAAGAAGPLDGIRVLELGTLIAGPFAGRLLGDMGADVIKVELPRAPDPLRTWGQAEVDGHHVFWTVHARNKRAITLDLRHPRGRELFCELVEKSDIVVENFRPGTLEKWNLGYDVLCERNPGIILVRVSGYGQTGPDAAKAGYASVAEAASGLRHLNGFPGGPPPRLALSLGDSLAGMFGAQGALAALYRRSVTGRGQVVDVALTESCLAVQESTIPDYDVGGVVRGPSGTRLEGIAPSNIYRSADGSWVVIAANQDTVFARLCKAMGRAELATDERFATHVARGRNQDELDGIIGEWAAQRQPDEIIETLSAAGVIAGPINTVAEVVNDPQLRARDMLVEHYDERLRRNVLGPGIVPVLSESPGRLRNAGPARPGQHNDEVYRGLLGKTAEELEELRAQEVL

SEQ ID NO: 4622 - protein, 301 aa, Mycobacterium paratuberculosis
VNTHVAIREVALRDGLQIEAPIPLSAKLELLAAVAATGVREVEATAFVSPSKVPSMADAAELAAHLADYPDIEFSALVASPNGARRAVAAGLRAIEYVVAADDTFSAANVGRTSAEATEQIGDIVAIAHDGPGPPVTVEVVIATAWDSPFEGPTPPQRVLDIAAAARDRGADRLSIADTIGTATPGRVSSLIAQLLPVIGDMPLGGHFHNTRGCGLASAYAAVGAGVTRLDASVGGLGGCPFAPGATGNIATEDLVYLLTDSGFDVDVDLQAASAAAGVAKTLVGHDLPSALLRAGDRRRS

SEQ ID NO: 4623 - protein, 209 aa, Mycobacterium paratuberculosis
LRAGPLMPAELLTAKGRQTRQAIEQAARKLFAERGFHGTTLADITSAAGKSPAVFYRYFADKEDLLAALAESFLHEVVTPSGLSVHLPDSPDDDAFFTAVVTGYWNMFKQNIGIMIAVAQLAATQQRFAAVQNEFRRFGIDLVAASVRRAQEQGYGAELHPQHTAAAIALLFENFTTVFVGPSGLGIEISDEDAIATLSTIWKKTLYGV

SEQ ID NO: 4624 - protein, 412 aa, Mycobacterium paratuberculosis
VDFTLPEHLPGVLAEMDAFIEDEIKPLEREHIQYFDQRREHARTDWDNDGIPTREWEDLLAEMRRRADRAGWLRYGLPASLGGRDGSNVDMAVIREHLAHKGLGLHNDLQNESSIVGNFPQVIMMERFGTDEQRREWSQALITGERSMAFGLTEPQHGSDATWLQTRAERDGDGWVINGAKRFNTGVHRATHDLIFARTSGEPGAAVGITAFLVPTEAPGFTVPYYWWTFNMPTDHGEVELTDVRVPADAVLGEVDRGLEVAQTFLHENRIRQAASSLGAAQYCIDRAAEYAGSRTVFGKPLSVNQAVQWPLAELQTEAQMVRLLVQYAAWHLDRDHHMEVSDKVSMANYRANRLVCDAADRAMQIFGGLGYSRHEPFEHIYRHHRRYRITEGAEEIQIRRVAQRLFKFGKK

SEQ ID NO: 4625 - protein, 265 aa, Mycobacterium paratuberculosis
MELEAQAQAAAAAAGAPVPHILVADNSPAALGNPFLICDEIKGETIARRIQRRLDAADGHAARAHLLGQCAHAVAAIHRAEIDRIQDPGLRRQDQLTEWRQRLDDMGDTTATFEWAFRWLAARRPRAAPAVLAHGDFRMGNLIVDGAQLAAVLDWELVHVGQAYEDLAWFCIRAWRFGAPAGFGAGGLGSIESFLRAYEQASATTVDRAAFHWWLVLATLRWGVICRYQAERHLSGLHRSVELATIGRRVCETEWDLLNLLEGAA

SEQ ID NO: 4626 - protein, 128 aa, Mycobacterium paratuberculosis
MTASGAKTVVDTADRLFAAIERGDVTAVAAMWSDDIAVWRVGSRRDDDKARAVRVIDWFIGATARRRYQILDRQLFDGGFVQQHVLHATGHGGQAISLRVCIVIRVGAHGMIERIDEYFDPAGIAPLM

SEQ ID NO: 4627 - protein, 178 aa, Mycobacterium paratuberculosis
MTTLETLLHDPEMAGVWNLVPDRSAITFRIKNMWGLLTVRGRFTDFTGDGQLTGKGAVFGRVDIRAASLDTGIGRRDQHLRSPDFFDVERFEKISVVVTGLQPTKGKIADLRTDFTVKGVTAQLPLPVTILELDDGSIRITGETTLDRARFDLGWNRFGMIGRTATAAADVIFVRDSQ

SEQ ID NO: 4628 - protein, 137 aa, Mycobacterium paratuberculosis
VSDSTPQSSVALRILVYSSNAQTRERVMRALGRHLHPDLPELSYVEVATGPMVVKTMDQGGIDLAILDGEATPTGGMGIAKQLKDELDTCPPLVVLTGRPDDAWLASWSRAEAAVPHPIDPILLGRTVLNLLRTPVR

SEQ ID NO: 4629 - protein, 125 aa, Mycobacterium paratuberculosis
LNVYIPILVLGAIATAFAVGSVVIASLAGPSRFNKSKMAAYECGIEPTETSVSGPRATAGQRFPVKYYLTAMLFIVFDIEIVFLYPWAVSYDALGTFALIEMVVFMLTVFVAYAYVWRRGGLTWD

SEQ ID NO: 4630 - protein, 184 aa, Mycobacterium paratuberculosis
VGLEEQLPGGILLSTVEKVAGYVRKNSLWPATFGLACCAIEMMATAGPRFDIARFGMERFSATPRQADLMIVAGRVSQKMAPVLRQIYDQMAEPKWVLAMGVCASSGGMFNNYAIVQGVDHVVPVDIYLPGCPPRPEMLLYAILKLHEKIQQMPLGVNRETAIAEAEQAALSARPTIEMRGLLR

SEQ ID NO: 4631 - protein, 235 aa, Mycobacterium paratuberculosis
MSSPDQDPREAIAQGDDEVIDVRRGMFGAAGTGDTSGYGRLVRTVTLPGSSPRPYGSYFDDVVDTLTESLQSNGIEFHQAIEKVVVYRDELTLHVDRAALPHVAQHLRDDPRLRFEMCLGVSGVHYPHETGRELHAVYPLQSITHNRRVRLEVAVPDEDPHIPSLYRIYPTTDWHERETYDFFGIVFDGHPSLTRIEMPDDWHGHPQRKDYPLGGIPVEYKGAQIPPPDERRAYN

SEQ ID NO: 4632 - protein, 441 aa, Mycobacterium paratuberculosis
MSTTTESTHDGAGETLVVAGGQDWDKVVEAARSADPGERIVVNMGPQHPSTHGVLRLILEIEGETVTEARCGIGYLHTGIEKNLEYRYWTQGVTFVTRMDYLSPFFNETAYCLGVEKLLGITDQIPERVNVIRVMMMELNRISSHLVALATGGMELGAMTPMFVGFRGREIVLTLFESITGLRMNSAYIRPGGVAQDLPPNAKTEIAQALDQLRQPLREMGDLLNENAIWKARTQDIGYLDLTGCMALGITGPILRATGLPHDLRKSEPYCGYENYEFDVITADTCDAYGRYMIRVKEMWESIKIVEQCLDKLQPGPIMVENGKIAWPADLKVGPDGLGNSPEHIAKIMGGSMEALIHHFKLVTEGIRVPPGQVYTAVESPRGELGVHMVSDGGTRPYRVHYRDPSFTNLQSVAAMCEGGMVADLITAVASIDPVMGGVDR

SEQ ID NO: 4633 - protein, 252 aa, Mycobacterium paratuberculosis
MTGPQGQPVFLRLGPPPDEPNAFVVEGAPTSYPPEVRARLEVDAKEIMGRYPDKRSALLPLLHLVQSQDSYLTPAGLEFCGEQLGLTGAEVSAVASFYTMYRRGPTGDYLVGVCTNTLCAIMGGDAIFDALKEHLGIDNDETTPDGSVTLQHIECNAACDYAPVVMVNWEFFDNQTPESARELVDSLRAGEPRHPTRGAPLCVFRETSRILAGLPDERPDQGQGGAGAATLAGLKVAKEHGMQAPNPAEGQQ

SEQ ID NO: 4634 - protein, 453 aa, Mycobacterium paratuberculosis
MTTTSETSEASGAPQATPLTPVISRFWDDPESWTLQTYHRHGGYTAMKKALAMEPDAVIGMVKDSGLRGRGGAGFSTGTKWSFIPQGDTGAAAKPHYLVVNADESEPGTCKDIPLMLATPHVLIEGVIIAAYAIRANHAFIYVRGEVLPVLRRLQNAVAEAYAAGYLGRDIDGSGFDLELVVHAGAGAYICGEETALLDSLEGRRGQPRLRPPFPAVAGLYGCPTVINNVETIASVPSIIGNGVDWFRSMGSEKSPGFTLYSLSGHVTRPGQYEAPLGITLRELLDYAGGVRAGHRLKFWTPGGSSTPLLTDEHLDVPLDYEGVGGVGSMLGTKALEIFDETTCVVRAVRRWTYFYKHESCGKCTPCREGTFWLDQIYERLETGKGTAEDIDKLLDISDTILGKSFCALGDGAASPVMSSIKYFRDEYVAHVENGRCPFDPRDSMLTPNGSDS

SEQ ID NO: 4635 - protein, 773 aa, Mycobacterium paratuberculosis
VTQTADTEGRVTQPEMVTLSIDGNEISVPKGTLVIRAAELMGIQIPRFCDHPLLEPVGACRQCLVEVEGQRKPMASCTTVATDDMVVRTQLTSEAADKAQHGVMELLLINHPLDCPMCDKGGECPLQNQAMSNGRSDSRFTDVKRTFAKPINISAQVLLDRERCILCARCTRFSEQIAGDPFIDMQERGALQQVGIYANEPFDSYFSGNTVQICPVGALTGTAYRFRARPFDLVSSPSVCEHCASGCAQRTDHRRGKVLRRLAGDDPEVNEEWNCDKGRWAFSYATQPDVITTPLVRDADGSLQPASWSHAIAAATRGLESALGNTGVLVGGRATWEDAYAYSKFARIVLGSNDIDFRARPSSAEETDFLAARIAGRPITVSYSDLESAPVVLLAGFEPEDESPIVFLRLRKAARKHGVPVYAVAPFATRSLTKMSGRLIKTAPGAEASALDRLATGEVGDLLSTPGAVIMVGERLATAPGGLSAAARLADTTGARLVWVPRRAGDRGALEAGALPGLLPGGRPVADDDARAQIASAWNVSELPCGPGRDVQEMLAAAAAGTLGALLVGGVDPDDFADPQAVLAALDGVGFVVSLELRHSAVTQRADVVFPVAPTTQKAGAFVNWEGRFRPFQAALRGSMTQAGQSDHQVLDTLADELGVYLGTATVEEIRTEYAALPYWEGKRAAGPDVAAAEPAPPGAGEAVLTGWRMLLDNGRMQDGEPHLAGTARQPVLRLSADTAAEIGAADGDAVTVSTPRGSISLPLVITDMPDPG

SEQ ID NO: 4636 - protein, 31 aa, Mycobacterium paratuberculosis
VVWLPLNSSGSAVHRQLGVTVGATVRIGVGS

SEQ ID NO: 4637 - protein, 409 aa, Mycobacterium paratuberculosis
VLGKALAIFVFLMLNVLVAILLERKILGWMQLRPGPNRVGPWGVLQSLADGIKLALKETITPGGVDKFVYFAAPVISTIPAFTAFAFIPFGPVVSVFGHRTPLQLTDLPVAVLFILGLSAIGVYGIVLGGWASGSTYPLLGGVRSTAQVISYEVAMGLSFAAVFLYAGSMSTSQIVAAQDRVWFVFLLLPSFVIYLISMVGETNRAPFDLPEAEGELVAGFHTEYSSLKFAMFMLAEYVNMMTVSSLATALFFGGWHAPWPLNMWAGANTGWWPVLWFTAKMWTFLFIYFWLRASLPRLRYDQFMGLGWKLLIPASLVWVLIAAVIRTLQNQGYAHWTPILVISSIVFAAALVLSLRKPFTTPHIRALRRQLRRKAKQLPTAPDSTPVFPTPPLPAKALAAASKEKARG

SEQ ID NO: 4638 - protein, 181 aa, Mycobacterium paratuberculosis
VAKFLDAVAGFGVTFASMFKKHVTEEYPEKPGPVAPRYHGRHQLNRYPDGLEKCIGCELCAWACPADAIYVEGADNTEELRYSPGERYGRVYQINYLRCIGCGLCVEACPTRALTMTNDYEMADDNRADLIYEKDRLLAPLLPEMTAPPHPRAPGATDKDYYLGNVTAHGLREAQRAGEPR

SEQ ID NO: 4639 - protein, 274 aa, Mycobacterium paratuberculosis
VSAFAGHAVAATLASSYSQDTIVRTSTGEAVTFWVLGALAVIGALGVVLAVNAVYSAMFLAMTMIILAVFYMIQDALFLGVVQVVVYTGAVMMLFLFVLMLIGVDSAESLRETLRGQRVAAVAAGVGFGILLIAAVGNVASGGFAGLTTANANGNVEGLAALIFSRYLWAFELTSALLITAAVGAMVLAHRERFERRKTQRELSQERFRAGGHPTPLPNPGVYARHNAVDVAALLPDGSYSKLSVSPILQSRGGDGKDVAAPEPSPSLSQGGAS

SEQ ID NO: 4640 - protein, 99 aa, Mycobacterium paratuberculosis
VNPINYLYLSALLFTIGAAGVLLRRNAIVMFMCVELMLNAVNLAFVTFARMHGHLDGQMIAFFTMVVAACEVVIGLAIIMTIFRTRKSASVDDANLLKG

SEQ ID NO: 4641 - protein, 628 aa, Mycobacterium paratuberculosis
MTHYTPLLVALPLAGAAILLFGGRRTDRWGHWLGCATAVAAFVVGVGLLDELLGRPADQRAIHERVFSWIQVGQLQVDLGLQIDQLSVCFVLLITGVGSLIHIYSVAYMAEDADRRRFFGYLNLFLASMLLLVIADNYVVLYVGWEGVGLASYLLIGFWYHKPTAATAAKKAFVMNRVGDAGLALGMFLMFSTFGTLSYAGVFAGAPAAGRGALTAMGLLLLLGACAKSAQVPLQAWLGDAMEGPTPVSALIHAATMVTAGVYLIVRSNPLYNLSPDAQLAVVIVGAVTLLLGAFIGCAKDDIKRALAASTMSQIGYMVLAAGLGPTGYAFAIMHLLTHGFFKAGLFLGSGAVIHAMHEEQDMRRYGGLRAALPVTFVTFGLGYLAIIGVPPFAGFFSKDAIIEAALAAGGGRGYLLGGAALLGAGVTAFYMTRVMLMTFFGEKRWAPGSHPHEAPGLMTWPMILLAIGSLFSGGLFAVGGTLQRWLEPVVGRHEEVTHAVPVWISTALALGVVAIGIAVAYRLYATAPIPRVAPLSVSPLTTAVRNDFYGDAFNEEVFMRPGAQLTHALVEVDDAGVDGSVNALAALVSATSNRLRGLQTGFARNYALSMLTGAVLVIALILAVRLW

SEQ ID NO: 4642 - protein, 642 aa, Mycobacterium paratuberculosis
MTHYTPLLVALPLAGAAILLFGGRRTDRWGHWLGCATAVAAFVVGVGLLDELLGRPADQRAIHERVFSWIQVGQLQVDLGLQIDQLSVCFVLLITGVGSLIHIYSVAYMAEDADRRRFFGVNHLPWLSILWLVPLAGSVLIILMPPGLRQLAKWTGLVFGVLTLAVAIVVTAGFKTGGAPYQFVEKHQWIPAFGAGYTLGVDGIAVVLVLLTAVLIPVLQVAGWNDGGDRQRGVHAYVALTLAIESMVLVSVIALDVLLFYVFFEAMLIPMYFLIGGFGAGSGRSRAAVKFLLYNLFGGLIMLAAVIGLYVVTSQHGAGTFDFRDIVAGVASGRYGADPAVSKALFLGFMFAFAIKAPLWPFHRWLPDAAVEATPATAVLMMAVMDKVGTFGMLRYCLQLFPDAATYFRPLIVVLAVIGVIYGAIVAIGQADVMRLIAYTSISHFGFIILGIFVMTSQGQSGSTLYMLNHGLSTAAVFLIAGFLISRHGGSRAIVDYGGVQKVAPVLAGTFLVSAMATLSLPGLAPFVSEFLVLLGTFNRYWLAAAFGVTALVLSAVYMLWLYQRMMTGPVAGGNEKIGDLRARELVVVAPLIALLLVLGIYPKPVLDIINPAVENTMTTIGQHDPAPSVPMGTPRTAEGRR

SEQ ID NO: 4643 - protein, 527 aa, Mycobacterium paratuberculosis
MMTLPTPSIQYFLLCPTLIVFGVAVAGVLAEAFLPRRIRYTAQVTLALGGLVAALFAVIEVAESLPASGRAAVLGAMAIDRPTLYLQGTVLLVAVMAVIFIAERTQTKSDSKVAVVAGSGGLDSFTPQASAVPDSDAEREAERAGAAQTELFPLAMLSVGGMMVFPASNDLLTMFVALEVLSLPLYLMCGLARHRRLLSQEAAMKYFLLGAFSSAFFLYGVALLYGATGTLLLTGIRDALITRGDTSLALVGVALLSVGLLFKVGAVPFHSWIPDVYQGAPTPITGFMAAATKVAAFGALLRVVYVALPPLHDQWRPVLWTISILTMAVGTITAVNQGDVKRMLAYSSVAHVGFILTGVIADNHTGLSATLFYLLAYSFSTVGAFAIVGLIRDADGVEDATLSHWAALGQRSPIVGVMFSMFLLAFAGIPLTSGFVSKLAVFKAAAQGGAVPLVIVGVVASGVAAYFYVRVIVSMFFTEATEDTPHVVAPGILSKAAIAVCAAVTVALGVFPQPLLDLADQAAQLLH

SEQ ID NO: 4644 - protein, 230 aa, Mycobacterium paratuberculosis
MTTTDPDDLTARARIRHAALREFGEKGYEGATIRSIAAAAGVSSGLLRHHFGSKQELRQACDDYLVKTMRDLNAQVQDNAKRGDVHYVSARIPLGQHQDYITRALVEGGAGELFDALVSMTEEWLASADEHRAEPADVDAKSRATLITAMALAIPLLRQHISRGLGVDISTEQGDLRVAAILVDIYSNPLLTPEQAKSARDDLAGRLSAAAGPPGRPGRAAAAGRRPAPR

SEQ ID NO: 4645 - protein, 276 aa, Mycobacterium paratuberculosis
MGIDTSAITPEEETAFLTLQARAINNGWARPILPDPGAADAVTKIDYDFDGLGLVTPVVCQTSLRAKLLDDRVRAFIAQHADAVVVDLGAGLDDGYARVKPPDTVDWYSVELPGLAALRDKVMPPGPHEHTIGISVTDPEWISAIPADRPAIVIADGLFPFLNKEQIIAVMRAITDHFPAGQLAFNDYGRMVIGVWISKLFPQRMFKKVNQLRAFEGYNDPHTPERWNPKLTLVEETSLASVPEVDLFPTWLRIATRMAGWSKRTARSARILRFSF

SEQ ID NO: 4646 - protein, 71 aa, Mycobacterium paratuberculosis
LCATAYLVCRHAVGTPVPVILGSRTTAVAAVGFSFAGLVATSFPLQLPWLPLLAPLGALAIYLLAIRPFLS

SEQ ID NO: 4647 - protein, 383 aa, Mycobacterium paratuberculosis
VAADRLRRAAARGAGHDQLAATGAGGRPARRTRHAALLRGRGGARDGVGDRRAGPVRGPADGSARRGNGTAGGESGSGHGKTVRATAQRWGRYHVAARVDVLARGGLLSGTALVDAAEVIVFPLTPPQPTPIPRTELLDRLGAHLTRHVGPGVEYADIRPYVPGDQLRAVNWAVSARRRQLHVTQRLTDRAADVVVLIDGYRQPAGPATLATERIVRGAAQVVQTALRHGDRAGIVALGGNRPRWLGADIGQRQFYRVLDTVLAAGAGFEHTTGTLAPRAAVPAGAIVIAFSTLLDTEFALALIDLRRRGHVVLAVDILEGSPFEDEQDPLVDRMWALQRSAMYRDMATVGVDIVWWPGDRGLEQSMGVLPDRRRRVRGRLRG

SEQ ID NO: 4648 - protein, 143 aa, Mycobacterium paratuberculosis
VTAPRAAEFRWRASELTRAMATCAAFALAAAVIGARWQLIAFAAPLLGVLGTISWQPRVPAVALHAEPDTQRCFEGEAAHVTVWGIEEQGPCAVRLTVPPVEGMELQVANPVRATAKPCGPPRSAGAATTSRRGWTCWPAAGC

SEQ ID NO: 4649 - protein, 325 aa, Mycobacterium paratuberculosis
MTLPAATTTAHCEAILDEIERVVVGKRNALRLILTAVLARGHILIEDLPGLGKTLIARSFAAALGLQFTRVQFTPDLLPADLLGSTIYDMQSGRFAFRAGPIFTNLLLADEINRTPPKTQAALLEAMAEGQVSIDGETHRLPKPFIVLATDNPIEYEGTYPLPEAQLDRFAIRLELRYLSERDETSMLRRRLERGSAEPAVNQVVDAHDLLAMRESVEQVTVHEDVLHYVVSLANATRHHPQVAVGASPRAELDLVQLARARALLLGRDYVIPEDVKALATAAVAHRITLRPEMWVRKIQGADVIGELLHRLPVPRTGAGPGQTG

SEQ ID NO: 4650 - protein, 160 aa, Mycobacterium paratuberculosis
MKKTVALGLCLIIGIELLALTQHDRRLVLTASGVGLALVLLSLRRALGRGAERESKHDADDLGDSLRRWLAATETTIRWSESTRADWDRHLRPMLARRYAIATGQRQAKDPASFQATGQMLFGAELWEWVNPNNVTRTGGRQPGPGRAALEEILRKLEQV

SEQ ID NO: 4651 - protein, 317 aa, Mycobacterium paratuberculosis
MPGMDKPTGRVVALIVLLLVVAALRGYLPAQHDATRSEAGGRAALGLVVAILAVTLALIAVAIVARLKDPRAPAPPAGALSETLGAGRGRPTWRVLLIGLGVIVAWLLIVMLLARLFASHGLSPAPPPGTGASPPPHPAAPPAPPPQHPQRPRDGSQDTLGILLAGTVAMLLMVVASAVAGARRRWRSPAPAVPDEPAENPAPQPHSESLARAAERGLAEMADLRRDPREAIIACYAAMERELAHVPGAVPQDFDTPSEVLARAVEHHALHADNAVQLVNLFTEARFSPHVMNEGHRDVAVRVLRLVLDELGSRSVA

SEQ ID NO: 4652 - protein, 448 aa, Mycobacterium paratuberculosis
RIGAALDAIDAAHDVLRQTSSDLVGTGFRIDVAERLETQDRTNRGLMYRFFGEIADPPDEAGSLPVARSMLWARLRVSPGELRRRFALAARIRPRRSLTGPPLDPELPALAAAVAAGAVGEDHIRAVCAAVDALPCAVPRSATSDAERTLVRHAAKLDAAVITKLGRRIADYLNPDGEFSDVDRARRRGLHLGPQGVDGMSRLSGLLGPETRAYFEAVASAVRPGRHQPEGGGDPRARDERTPSQRCHDALKLGLEVAIASGGLGVHRGHPVTVIASTTLAELDQAARAVADPSIPMPAPALTGGGSRLPMPDMIRMAAKAIHYLAVFDEHTGRPLYLGRQKRVATADQRLICYARDRGCTRPNCLEPGYRCEVHHAPDWADGGGTDADKLFFACGPDHGAVSRGEWRTSVGDDGRLAWTDGNGPPQINRAHHPDELLRGDPDPPEND

SEQ ID NO: 4653 - protein, 316 aa, Mycobacterium paratuberculosis
VGGADDGDRGARGAAVTGRLTGRAAIVTGASRGLGRAIALALASEGAAVAVAGRTEQVWDDRLPGTIGSTVADIEAAGGRAVPVRADLTDRDDVARLVDSAREALGPITILVNNAAFTAPGRPPAPGGEARAKPAAGGAKPASGGAKPASGGAKPGWPGFVSTPLHAYRRHFDIAVFAAYELMQRVCPDMIGAGGGAIINITSVASRLPGDGPYADRSGGVLPGYGGSKAALEHLTQCVAYDLADHRIAVNALSPSKPILTPGLSYYARDFDDTASADEFARAAVELALVDPGRVTGRTIGHLQVLDGSFRPFGLD

SEQ ID NO: 4654 - protein, 214 aa, Mycobacterium paratuberculosis
LRLFRGNYDTVGSVMKADPSGLDKAPGAGRPRDPRIDSAILSATAELLVQTGYSNISLAAVAERAGTTKSALYRRWSSKAELVHEAAFPTAPTALEAPAGDIAADMRMMIEATRDVFTTPVVRAALPGLVADMTADPALNARVMSRFADLFTAVRVRLREAVDRGEAHRDVDPDRLIELIGGATMLRMLLRPEEELDDAWVEQTTAIVVHGVRR

SEQ ID NO: 4655 - protein, 381 aa, Mycobacterium paratuberculosis
MEAPVATEPAVDSVDRLQRSSRDVTTVPAVMSRWLSTVLPDGAEPEVTVESGVDSTGMSSETIILTARWRQDERPTEQKLVARVAPTAEDVQVFPTYRLDHQFEVISKVGELTDVPVPRVRWLENTGEVLGTPFFVMDYVDGLVPPDVMPYTFGGNWFADAPAERQRELQDATVGVLAKLHSIPNAANTFGFLTEGQTGDTALRRHFNWVRSWYDFAVPDIGRSPLLERTFDWLEAHWPAAADAAEPVLLWGDARVGNVLYRDFVPVAVLDWEMVTLGPRELDVAWMIFAHMVFQELAGLATLPGLPGVMREDDVRATYERLTGVEIGDLHWFYVYSGVMWACVFMRTGARRVHFGETEKPDDVESLFYHAGLMKRLIGEE

SEQ ID NO: 4656 - protein, 413 aa, Mycobacterium paratuberculosis
VGVRVHAHRRAPGAFRRDRKTRRRRIAVLPRGIDEKTYRRRVMLGPLDEYPVHQIPQPIAWPGSSDRNFYDRSYFNAHDRTGNIFVISGIGYYPNLGVKDAFFLVRRGDTQTAVHLCDAIDQDRLNQHVNGYRIEVKEPLRKLRLVLDETEGVAADLTWEGLFDVVQEQPHILRSGNRVTLDAQRFAQLGSWSGRIVIDGQEIAVEPATWIGSRDRSWGIRPIGEPEPAGRPADPPFEGMWWLYVPMAFDDFAIVLIIQEQPDGFRSLNDCTRVWRDGRVEQLGWPRVKIHYRSGTRIPTGATIEASAPDGTPVHFDVESKLPVPIHVGGGYGGDSDWLHGMWKGEKFTERLTYDMTDPAIIARSGFGVIDHVGRAICRDGDKAPVEGWGLYEHGALGRHDPSGFSDWLTVAP

SEQ ID NO: 4657 - protein, 457 aa, Mycobacterium paratuberculosis
MSAARRIYLNAFDMACVGHQSAGLWRHPDDQGHRYRELSYWTELARTLEAGGFDALFLADVLGVYDIYGASRDAAVVDAAQFPVNEPSAAVSAMAAVTETLGFGITLSLTYEQPYALARRLSTLDHLTGGRVAWNIVTSYLDSAARNLGLDAQIPHDQRYEIADEYLEVCYKLWEGSWEAGAVLRDRQRGVFTDPAKVHDIEHKGRYFSVPGPFLCEPSPQRTPVLFQAGASPRGIRFAAAHAEAVFVSGPTAQVVRESVRALRTAAAQLGRDPRAVKVFTMVTPVVAETHDAAVAKLAEYRRFVSPRGALALFGGWTGVDLAELDPDEPLTYVETDANRSALASFTTAGQAWTVAELAAEIGIGGRGPVLVGSPTEVADELERWVDDADVDGFNVAYVTTPGTFVDFAKFVVPELRRRGRVPEEVPGSTLRERLGAAGPLLGDDHPGAAYRLRRDR

SEQ ID NO: 4658 - protein, 470 aa, Mycobacterium paratuberculosis
LRQSPSASARRSHHGDGKHSPAPTGSLPCNHVTLTSPAAASAGDLPARPGLRTVAAGSMIGTTIEWYDFYLYATASALVFKPLFFPNISPSAGTLASFATYAAGFGARPLGAVLSGHFGDRLGRKTVLVAALLVMGLVTTAIGALPTYAEAGLAAPALLASLRVVQGLAVGAEWGGAAVLSVEHAPPGRRGLFGSFTQLGSPAGMLLATSVFFGVRKATGPAAFLGFGWRIPFLLSIFLVAVGLFVRLRLTDAEVFDRLRSRDELARLPIVQVLRTDARNVVITTGLRLSQIGLFVLLTTYSLSYLQDSFGKGSGVGLVAVLISSALGFLSTPGWALLSDRVGRRPPYLFGALVSVVALVLFFVAAGTGSAVLVVVAIVFGVNVVHDAMYGPQAAWFAELFDTRVRYSGSSLGYHIGAVLSGGFAPLIAASLLVAGGGRPWLIVGYFAVLAAITVGAACAARETRGEPIG

SEQ ID NO: 4659 - protein, 448 aa, Mycobacterium paratuberculosis
VSGPPRIVDVVVVGAGFAGLAAARELNRQGHDVVVFEGRDRVGGRSFTGSVAGLPADLGGTFVGPTQDAVLALAAELEVPTTPTHHEGKNLIHWRGWTHAYHGTIPKLSLTGLLDIGRLRWQFDRIARSIPLAAPWEARRAAELDGLSLGGWLRSVRATASSHALLAMVARVTWGCEPDEVSMLHAARYAHAAGGLDRLLDVEDGAQQDRFPGGTQQIAAAAAAELGARVVLGAPVRRIERHGAGVTVRTDLGDTEAGFVIVAIPPAHRAAIEFAPPLPAEYEQLARHWPQGRLSKAYAAYSTPFWRADGFSGQALSDEGPVFITFDVSPHPDGPGILMGFVDARAFDSLPADQRRRDALRCFATLFGDDALKPLDYVDHRWGAEEFAPGGPTAAVPPGSWTRFGRWLREPVGPIHWAGTETADEWTGFLDGAIRSGRRAAAEVIALL

SEQ ID NO: 4660 - protein, 316 aa, Mycobacterium paratuberculosis
MRARTDPFPDRLPPSRTVTVRAVDGTRLHAQVFGPPDGYPIVLTHGITCAIRAWAYQIDDLAGDYRVIAYDHRGHGRSGVPKATGYSLKHLAADLDSVLEATLAPHERAVLAGHSMGGITIAAWSNRYRHKVSRRADAVALINTTSGELIRQVQLLSVPPGLSPARVLAGRALIGAFAGFAVPRAARVPSRHLVALPATGRDADPAIARLVYELFENTAPAGRAGCARALVSALGSRYLDLAGLTVPTLVIGSERDRLTPIRQSRRIAEGLPNLIELVELPGGHCSMLEHPREVNRRLRALAESATRNLPTHRISS

SEQ ID NO: 4661 - protein, 358 aa, Mycobacterium paratuberculosis
MGLTTMTVRDDGAPVGAPAEAVRSDYGPVDPVLAVNGERRARPVAVEYKQFHGADAQSARRFFATAYDPGWRIAGVTNHCVVSHRRSDTGSMTVDEVAIQGRMTLEIPAGDTVVVIQPRAGALNVAGGPLATPDFPLLVAHGMACVLHCHGARFDVVTIAAEVLQKVAAEWHTALSQQTQFLNWRPRSRAAVRAWHRALDYAMATLASPDTARQPLIAAGMAGLLAGALLECYPSNLTEQDPVSDLALPETLKEAVSFIHRHATEDIGINDVAAAVHLTPRAVQYLFRRQLDTTPTEYMRRVRLSRAHQELVAATTASSTVTEIAQRWGFAHTGRFAVLYRQTYGQSPHTTLRQQTAV

SEQ ID NO: 4662 - protein, 392 aa, Mycobacterium paratuberculosis
LQLRIAIVSGDDVVGEDPEQLGAALAAQGHDVTTCLRRAGRRRGGSAPDGYRRVSVPVGPHDAAAPVDVLPYVGDWAGALERIWSKDRPDVVHAYGWLGGLAAQLAARRRHIPTVQSFLGLAATARGHDGERGTERQRIEPLLARSANWVTGESSADVDALARLRRRRVRVSALTCGVDAERYTPTGPADSRGALQRILYVAPNPLWHNGIDLAIRALPKVRGAELVIAETDPGGDGHDGARAQLLRLSVHLGVADRVRFAGPVGGDELPRLLRSADVLVCTPRRPPRPTPVLQAMASGVVVVVATMGVLSDVVLDDITGIVVSPENPARLAAALRRLLAQKFQCESMGAAGRSRAQSRFAWQRIALDALNIYQSLGVHEPAAPLDGDAVLR

SEQ ID NO: 4663 - protein, 309 aa, Mycobacterium paratuberculosis
MRRRVETERVTTEADRPGVELVALVASAGGLEALTTVLRDLPRDFPAAVVVQQHLAGHDSLLATILTRQSGRPVGWAANGRAVTPGEVVICPPGKALELTPQGRCRLHGAQQHGARGADVLLTSIAGSYGPRGVAVVLSGSGRDGAAGTVAMRRAGGVVIAESPATALYPSMPIAAAQAGADLVLGIGEIAPVLADLVHGLPLPRRSPPADAPDEAYLDGGVDPDGIFARLAARFGANTPAARAELARLRAAELRRRRQELSAGVGATRETVATARRRAEESRRRALLAHRAADEAWARSEQEHRDRDG

SEQ ID NO: 4664 - protein, 616 aa, Mycobacterium paratuberculosis
MNSTTDEADEAFEALLRYMRDSRGFDFTGYKRTSLMRRVRHRMDQAGYTAFDEYLDFLQASSDEFTALFNTILINVTSFFRDPDAWEFVAAEVIPRLLAERGPNDPIRVWSAGCASGQEAYTLAMLLAEALGFDAFRQRVKIYATDVDEDALTEARGASYDARAVESVPADLLARYFEQVNGRYVFHKDLRRAVIFGRNDLVKDAPISRVDLLVCRNTLMYLNAETQRNVLGRLHFALAPQGTLFLGHAEMLLSHGDRFTPLSLKHRIFRKAVGSHSGLDHYDPAGAFYERHADLPGLATVRDLAFRASPVAQIVVTGEDTVAMINQQAETVFGLSARDIGRLLRDLEVSYRPVELRAYLEQAKVERRSARIQDVKWQRPGAETVWFEIHVNPLVDAENGLLGVSIVFFDVTATRALLDKVVQTNRQLEAAYEELQSTNEELETTNEELQSTVEELETTNEELQSTNEELETMNEELQSTNDELHTINDMLRERSLELDDAKSFLDSLVDSVRMGMVVVDREMKVILWNRGCEELWGLRADETTGTMLTALDIGLPLDAVRPLIGNAFVDPDGSGEVVVDAVNRRGRPARVRVTCTSFRGNEGTVGGALLLMDVVG

SEQ ID NO: 4665 - protein, 252 aa, Mycobacterium paratuberculosis
VNEQRSAVQIASEQDRDVPVLTVDGVLDSSTYRTVRDTVIKAAIDEPRAVVVDVDRVRAPSASAWTVFTSARWHVSIWPDVPILLVCAHPQTRREITTAGVTRYVPVHPTRELAVRAVHGRTLQVRRRARTELPRSDTSLHLARAVLTDWLTQWDIREVIPVAATVATVFVENVLDHTESAPVLIVESHRDTVTVAVEDNSFALPGRHEDADRGADIVSGLAIVSALCRVWGATPTSSGKTVWGSVGREDRI

SEQ ID NO: 4666 - protein, 339 aa, Mycobacterium paratuberculosis
VVIAAADGDLQSDLRGAVAIGASAGGVEALSNLAAGLSPDVPFAYLMVLHVPAGAPSILARIIDRSGPLPASAAQDGAPLQPGHIYVGVPDRHLLVDGAHVLLSQGPTENGHRPAINALFRSVALTFGPRAIGVLLSGVLDDGVLGMAAIRSRGGVTVCQSPDDALFPAMPANALDAGVVDRQAAAADIGVVLKELAHREIEDPDMQRDPGMELENRIAMMSRFATDFDTEKLGPPSGYTCPDCNGSLVSLSEGNYRCRVGHAWTAEALLSARDNELEGALWVAVRSLQEKARLARDMAGKAGAGLLSRRYTQIAEESERALHVLSHRLAGAAAEGETR

SEQ ID NO: 4667 - protein, 398 aa, Mycobacterium paratuberculosis
MATDHTSGAPDPKQRDLESARFRRDTGYLTTQQGVRVDHTDDALTVGERGPTLLEDFHAREKITHFDHERIPERVVHARGAGAYGYFEPYDDRLAQYTAAKFLTSPGTRTPVFVRFSTVAGSRGSADTVRDVRGFATKFYTEQGNYDLVGNNFPVFFIQDGIKFPDFVHAVKPEPHNEIPQAQSAHDTLWDFVSLQPETLHAIMWLMSDRALPRSYRMMQGFGVHTFRLVNARGEGTFVKFHWKPRLGVHSLIWDECQKIAGKDPDYNRRDLWEAIESRQYPEWELGVQLVAEDDEFSFDFDLLDATKIIPEEQVPVLPVGKMVLNRNPDNFFAETEQVAFHTANVVPGIDFTNDPLLQFRNFSYLDTQLIRLGGPNFAQLPVNRPVAQVRTNQHDGY

SEQ ID NO: 4668 - protein, 525 aa, Mycobacterium paratuberculosis
VGLRVAAARDVARHHVADVGPGAAAQLPHDAGVRGAHLPAGERPRRGDFREVPLEAPTRRALADLGRMPEDRRQRPRLQPPRPVGGHRIPPVPGVGAGRAAGRRGRRVQLRLRSAGRDENHSGRTGSGIAGGQDGVEPQPRQLLRRDRAGRFSHRQRGAGHRFHQRPVAAVPQLLLSGHAADPVGRPQLRAAAGQPPGGAGTDQPARRLRTNQHDGYGQHTIPQGRSSYFKNSIGGGCPALADEDVFRHYTQRVDGQTMRKRAEAFQNHYGQARMFFKSMSPVEAEHIVAAFAFELGKVEMPEIRSAVVAQLARVDDQLAAQVAAKLGLPEPPEEQVDESAPVSPALSQVTDGGDTIASRRIAVLAADGVDVVGTQRFTELMEQRGAVVEVLAPVAGGTLAGGSGGELRVDRSFTTMASVLYDAVVVACGPRSVSTLSDDGYAVHFVTEAYKHLKPIGAYGAGVDLLRKAGIDNRLAEDTDVLNDQAVVTTKAAADELPERFAEEFAAALAQHRCWQRRTDAVPA

SEQ ID NO: 4669 - protein, 191 aa, Mycobacterium paratuberculosis
MTSGDARADTAAAAPRLREALRAAASALKEKGPRFALAGSYALWAYGAPEPSHDADLVVAEADVETAVTTLASAGFEIERPPEDWLFKARTGDMLVDVLHRLNGVPVDAQTLDRAEHHDVLAIGMPVLPPTMVLVQQLRSLGEHHCDFAKLLPAVRAVRERLDWDEIRAQTADNDYAVAFLVLAERLRLTR

SEQ ID NO: 4670 - protein, 95 aa, Mycobacterium paratuberculosis
VLDQPRRHAQSPATDPPNWPKRQAIPSSGPAPGRPASQPASTRLPAPVQVAGFAASLCAGITTATASSAHGTGVDITHDFPIGRKLNGLDNRAAP

SEQ ID NO: 4671 - protein, 319 aa, Mycobacterium paratuberculosis
LRVTAGLVKHWLESGRLELPLPASGRTAERWQRLAELAAENIVAARVAEAHVDAVAILHELGGKPPEPGQLWSVWAAEAPDAVLTATDIRGAYLLNGTKVWCPGAGFCTHALVTARRDDGTPGLFAVTVTDPTVKALPSTWWNAGMAGSDTRPVQFTNTHAVAVGDPGDYLIRPGFWHGAIGVAACWLGGARRVADPLYRCAASQSADAYSLAHLGAVDAALAAGDAMLAAAAAQVDADPFDRAGTAQLLARRVRTVVEHAVDEAITRTGRALGPGPLCQDGRHAQRVADLSIYIRQSHAERDLAELGRLAGRRAVRAP

SEQ ID NO: 4672 - protein, 252 aa, Mycobacterium paratuberculosis
VPAGSRARFAAKPLTHSGTPVPLWLAAFQEAPLPALDLAGCPGLVVVAAHPDDETLGVGAMITQLVAIGVRVQVVCVSDGGARPGSAASERLRAQTIRRFELRSATNTLNAPPPLSLGLPGGELTAHEDRLTGALTEILRAAGPGAWCAAPWRGDGHPDHEAVGHAAWAACAHTGAALLEYPVWMWHWAVPGDPAVPWERAHAVPAPAWAVSRKRLAAQRYRSRFEPTGGSAPALPGFVLARLLAVGEVVFR

SEQ ID NO: 4673 - protein, 260 aa, Mycobacterium paratuberculosis
VSGRKAMRVATFNILHGRTVCDGVNVERLRDCIRRLDPDVLSLQEVDCDQPRSEHADLTGAAAEAMGAVEHRFVAAISGTPGATWMAATGDEQPGTAAYGIALLSRYPVASWQVLRLPRIPMRFPMYLPGPNRVMIVDEEPRAAVIAQLRTPIGELTVANTHLSFVPGWNRRQLRRLIRDLRGLPGPRLLTGDLNMTPQTVRRWSGMRALGNAKTFPADNPNRQLDHILTDDRRLRCAAVQADLMPISDHRPLVVDLQRV

SEQ ID NO: 4674 - protein, 103 aa, Mycobacterium paratuberculosis
MGLGQLVGGVVGFLRAGYPRQAPAVGYAPTLALLPRRTADDDIATVARILAPQGITGTARIDAAEIGAQIVRIADELPAPGDVERVLAAMSRHTRCRSTTNGR

SEQ ID NO: 4675 - protein, 110 aa, Mycobacterium paratuberculosis
LKPTRTERARSADRTGPLPLAGSLLVLLLALLGGLRAGPRRLGLGFLLARVALGVGLVLLGLTLFGQVVAAEDGPADLLGLALHALDGAFDRFLRPALLVPHGFDLSGRW

SEQ ID NO: 4676 - protein, 346 aa, Mycobacterium paratuberculosis
VVSELALDGIQGVPAAGGVKRFVRYRARDVRAVTAGPAAGAGHAADRRSAGLNGPLLGSSPAARSRRQVRALTTIAVIGATGTAGSRVVARLRPRDVAVVEISRAQGVDVFDAPGLTRALEGVDVVIDVSNPVPPDGRSDIRQTLATAARNIMGACATQEVQRLVVLTIAGIEDPVFDEFPYYQAKREAKEILLDGPVPTTVVKSTQWYEFATNHDAVSCDDNEVIVEDWLIQPIAADTVADVLVETALAQTHTPRTITGPDAIRLPELTSKLLVRQGDRRAVRSVEPAVSALGAGALLASGHAVVVGPDVDTWLQTLAPPGGDGHRGAGGDGHRGADGDGKPRRG

SEQ ID NO: 4677 - protein, 132 aa, Mycobacterium paratuberculosis
MKISSIVARRKVAGVSAGCLLGGMAMGIVGAPSAAAAPDCSPSGVNSTVSAVEGSAQQYLAAHPDANQVVTAAYGQPRPQAESSLRSYFTGHPQEYNDLRGILAPIGDTERQCNVTALPPYLESAYQEFMAG

SEQ ID NO: 4678 - protein, 399 aa, Mycobacterium paratuberculosis
VAGRFRIRLRAPPRCERLLGWVSEANGPGPQLRCGRPLRTAEKTGGFRMRLRRSVLSKPGITRKRRGKGFSYHAPDGTTVRDPETLQRIKDLVIPPAWKKVWISPHPNGHIQAVGVDAAGRRQYLYHCAWQQERAEEKFDRVLELSTELPAWRARIAEDLAARGLTRERVLALGLRLLDRGYFRSGGEQYAEENESYGLSTLLCEHVTVRRDAVEFDFPAKSGVRRTVRVEDREVVRAVRPLMRRRHRGDRLLVCRTASGWSEVRADDLNDRFKELVGDQYTVKDLRTWHGTVLAAAAFAEADAAVSRRVARRVEAAVMKEVAEELGNTPAVARGSYVDPRVITGYERGLTIGAATRRAGRARDPDAAQEILDKATRMLIRRVAKGHSASGASVLPKSA

SEQ ID NO: 4679 - protein, 322 aa, Mycobacterium paratuberculosis
MLDPVRAKRVLVWHVHGSWTQSFVAGRHRYLIPVAPDRGPDGIGLAGRCWPNAREVAFEDLADRDIDLVVLQRPHEAELVARWAGRRVGVDVPAVYVEHNTPRPSAAQTRHPLADRADIPLVHVTDFNRLMWDNGIAPTRVIDHGVADPGRLYSGEIPRVATMINEPGRRGRVVGADLLEPLSAYAQIDVWGIGTEGLCANRGAVRGRGDVPTPRLFGDVARRRVYLHTARWTSLGLSLIEAMLLGMPVVAVGSTMAPFVIPCEAGVVSADPARLGEGLRGFLDDQARAVAAGKAARDFATARFGLKRFLADWDQVIGELCR

SEQ ID NO: 4680 - protein, 413 aa, Mycobacterium paratuberculosis
MSREGTRMRIAMISEHASPLAHLGGVDAGGQNVHVAELSCALARRGHDVVVYTRRDDPRLPDSVDTPHGYSVVHVPAGPARVLPKDELLQYMYGFAQFLRQQWCSDGPDVAHAHFWMSGVATQRAARAHSIPTVQTFHALGLTKRLHQGSEDTSPDCRIDVEARVAREADWVAATSTDEVFELVRMGRARSRTSVVPCGVDLDAFTPDGPVAARGARPRIVTVGRLVPRKGFDTIVRALPRIPDAELVIVGGPPAAELAGDEQARRLQRLTGELGVADRVRLLGGVTRAQMPALLRSADVVACTPWYEPFGIVPLEAMACGVPVVATAVGGIRDTVVDGATGRLVPPKDPDALGEAVAALLRDGRRGRTLGEAGRERARARYSWDRVAADTERIYERLSPARRGVGTPSTRSG

SEQ ID NO: 4681 - protein, 299 aa, Mycobacterium paratuberculosis
LPFGVVAPVMSTMPRTSFVIATRDRSAELTGTLTRLLDTTECPIIVVDNASRDDSVAAASRIAAAGRVTVIPLSRNAGAAARNIGVARCGTPYVAFCDDDSWWAPDAIARAEQIFDTFGTVALLAARTVLLPARRDDDFTEQLAHSPLGHRAGLPGPSILGFQACSALVRAWAFRRVGGFSPILHFRGEETLLACDLAADGWDLCFCPELVAYHRPSQIRSASRAQRARILRNALLTACLRRPVDRCARAGAALAWAALHDAAHAKALLEATAALPAALRERRRLPDAVERSLRMLESG

SEQ ID NO: 4682 - protein, 358 aa, Mycobacterium paratuberculosis
MTGATTPKGNGETGFHPRPDGYQSPMRSLTRVLITGGAGFLGAHLCARLLDDGVEVVSVDDLSTSGPAVRFGDRPGYRFVQRDVCEPGLIDEVGSGFDAVFHLASAASPVDYQRRPIQTLCTGSAGTATALEIAERAGARFVLASTSEVYGDPESHPQRESYWGNVNPAGPRSVYDEAKRFAEALTFAYHRLGRADVGAARIFNTYGPGMRADDGRMVPTFCLQALRGDPLTVSGTGLQTRSLCYVDDTITGLIALAHSDFAGPVNIGNPTELTVLSAAELIRELAGSTSTIQFTPPAADDPQRRCPDIRLARKRLGWRPRVDYRTGLSTTLAWFAERAGRTGESAQQLVATTDRRTR

SEQ ID NO: 4683 - protein, 546 aa, Mycobacterium paratuberculosis
VRILGVNAVFHDPAAALVIDGRVVAAAEEERFSRRKHGKPAVPFATWELPVAAIRWCLDHAGVRAEDIDAVGYSYDPALMYEEPLDPAGLDRDWEHLRTLYAERAPGFLKTALPGLNPAVVHHVRHHVAHAASTALASPHPETAVLVVDGRGERASMLAGVYREHKLDVLAVQQLPHSLGLLYESLTEHLGFTRSSDEYKVMAMASYGRPRFADRLRGRVYARGDGGFCTEPIDWEQLAPPRPPHAATLDPVHADLACSVQRVVEDVLLELVGWLRDRTDGDALCLAGGVALNCVANTRIHAEGGFDRVWVQPAAGDAGTALGAALHLAASFDEPIAPMPGAQLGRGWSDAAVRAALDDAAVNYERPHDLPSAVGDALAENQLIGWFQGRAEFGPRALGGRSLLADPRYPANAERLNAVKGREQFRPVAPMVLAERAAEIFSRGPLPSPYMLFVHDVGEHWRSRIPAVTHVDGTARIQTVDADADPLLHATINRFAQHTGVPVVVNTSFNTAGRPMVDTPRDALEVFGSSPIDVLAVGPYLVRRYL

SEQ ID NO: 4684 - protein, 333 aa, Mycobacterium paratuberculosis
VRHDDYTLVIPTVGRESLHRLLIALRSSMGPQPPEVVVVDDRPRPGDDLPLPDDPPVRVLRSGGRGPAAARNVGWRASRTRWVCFLDDDVLPDRDWISALCLDLKAADACGAAGSQAVLEVPTPRRPSDDQRRTARLATAQWITADMAYRRDILVAAGGFDERFPRAYREDSDLALRIVSAGGTILRGERRCTHPVAPATWRSSVRAQIGNRDNALMRRKHGRRWRTRIGEGPGRMPAHAATTAAGAVALLAGLLGRRATARRAAALWLLCTIEFAARRWLSGPRNVREALGLSASSVLIPPVAVAHRLAGEWTFGARVPSRRWPCCWTATTP

SEQ ID NO: 4685 - protein, 184 aa, Mycobacterium paratuberculosis
MDLRRARPEPPLAVLLDRDDTLIVDRPYLNDPAGVRPTHDAAKALTRLRRRGLLLAVVTNQSGVARGLISAGQLAAVNDRVDEVLGPFDSWQVCVHGASDGCGCRKPRPGLILAAAEALGVPARRCVMIGDTGADVRAALAAGAAAVLVPTDRTLPAEVEHARTHARVAATLNDAVSLVLSECR

SEQ ID NO: 4686 - protein, 517 aa, Mycobacterium paratuberculosis
VPMSTAVVARLDSAGDVLITGPAVRAVAARHDRVTMLVGPRGRAAAELLPGVDELIEWQAPWVDFEAPELTAAHAEALIKQLRGLAPDRVYICTSFHQSPLPLALLCRMAAVPWVGAVSVDYPGALLNLRHRVPDGIPEPQRALSLAEAAGCALPAGDDGALRIRAVDPLPARLAEQLAPRPFVVFHPGAAVPARRPSPSRSAAMVAALAGAGHRVVVTGSPDEAALTAAVAGDVAVDLGGRTSFAELAAVFAAARVVVVPNTGPAHLAAAVGTPVVSLFAPVVPAGQWRPYGRRVRVLGDQFAPCRASRARVCPVTPAWTASPTRSCSPPWQKAPWQKEGSHDRGPLRRAAGSGAAHQHPGPPVARVGRTAGHGAARRRPVVGLRERGQRRRGPAPHRRTGGPIPRGANSHVRHRLTRRHLGADRDRQRLRRRRGVRPRGAGARPAGRRAGGAVHQRRQPQHDRGGQGRARRRHGDLGADRTGPQRAGRHVRRGDLRGRRRHRDGAGGPSAADPRA

SEQ ID NO: 4687 - protein, 472 aa, Mycobacterium paratuberculosis
VHGARRPPFTTGSIMSTSKPLVVVGDSMLDVDILGSATRLSPEAPVPVVDAERHVQRPGGAGLAALLAARTEAPVVLITGIADDDAGRALHDLLSCSGVRVLALPVSGTTVCKIRIRARGQSVLRLDRGDATPVDGPLPAAAADALADARAICVADYGAGVTALPAVRAALTESARRVPVVWDPHPRGAPPVPGCALVTPNHEEARGFCHDDGSGDGGEALLRTWAADAVCITRGAQGARVYEPRADVHRVAIPQRAAPAAGDVCGAGDRFAVAAAVVRAAVGDAARFVAAGGAAAVSIPVSDTGSDPLTSRSRPADASAVDALGLAARLRRQGRTVVATGGCFDLLHTGHIRLLRQARELGDALIVLVNSDASVRALKGSGRPVMRDADRARVLAALACVDAVAVFDGLTPERMLEDLRPDIWVKGGDYVAAELPEADVVYRHGGEVVILPTVAGYSSSRLIAAAATGRPE

SEQ ID NO: 4688 - protein, 174 aa, Mycobacterium paratuberculosis
VASAVESLAGKVGGRITGVFTPAGIDSCGTLEQVPAKDWEQVIAVNLVGTAAVIRAALPYLKATGGRIVTCASTLGIKAVSDATAYCASKFGVVGFTRALAAELAGQVGVTLLIPGGMHTPFFDGRPEQYKPPADAKLNQPEDVAQTVLFALCQPAGCEVREMVVCASTESSWP

SEQ ID NO: 4689 - protein, 578 aa, Mycobacterium paratuberculosis
VAAGPVRGGGRGAARRRPRDPDHRITERIPPRAHRRPRRPVAAHRRGVRSPRPAGADRAGRRQPDGDLRRHRCGAPGRRDRHRLGGAVRPHLPAAVGTARAGAARRAVGRPQRRPARRDAAPRTARADRRAGAVGLPRGAGGDGMSTEPLVGVVGVGYVGLTTAVCVAAAGRKTVAVDINPDRVGRLRAGVAVIDEPGLSELLGDGLAGGVLRFSADFAELADRDVVFVCVPTPSAPDGHADLAAVESVIDRLGRVLRRGAVVALKSTVPVGTTSTMAQRLCHKGIRVVSTPEFLREGRAVDDFRNPDRLVIGSHDELAAQLVHQAYGLAGHRVLRMSPESAELAKYASNAFLAVKLSYTNSLAALCARVGADIDDVTCCMGADRRIGAEFLRPGPGWGGSCLPKDTAALLDIAHRHRVSFAEVEAARQTNTAQARRIVTALRHTLGRPLSGCRITALGLTFKAATSDTRESPALAACRELAAAGAQVAGHDPQLPNIDPAVLQQNRVTAVDDPYRAAKAADAVVVLTEWPQFRSLDWRAVAQDAPLAVVLDARNSLDPATVREAGLRYLGNGVPQGF

SEQ ID NO: 4690 - protein, 597 aa, Mycobacterium paratuberculosis
MSKQEVSDYLLERLRAWGVEHVFGYPGDGINGLLAAWGRADNKPQFIQSRHEEMSAFQAVGYAKFTGRVGVCAATSGPGAIHLLNGLYDAKLDHVPVVAIVGQTNRTAMGGNYQQEVDLLSLFKDVASDYVQMVTVPEQLPNVLDRAIRIAMTQRAPTALIIPADVQELPYSPPEHAFKMVPSSLGIEYPAIAPEDAAIARAAEILNAGKKVAMLVGTGARGAHHELAEVADLLGAGAAKALLGKDVLSDELPWVTGSIGLLGTRPSYELMRDCDTLLTVGSSFPYTQFLPEFGQCRAVQIDIDGRLIGMCYPYEVNLVADAKAALRALIPHLKRKEDRSWREGIEKNVARWWETMDKEAMVSADPINPLRLFSELSPLLPDNAIVTADSGSSANWYARNLRFRGNMRGSLSGTLATMGPGVPYGIGAKFGQPDRPVIVFSGDGAMQMNGMAELITVKRYWNEWKDPRLIIAVLHNNDLNQVTWEMRAMAGAPKFAESQNLPDVDFAAFAAGLGLNAMAIKDPDELSDAWRSALSADRPTVLDVYTDPDMPPIPPHATWEQFKSATAAVLSGDEDRTGFVKVGLKTKMQEFLPHKKS

SEQ ID NO: 4691 - protein, 221 aa, Mycobacterium paratuberculosis
MTATSKAPGADRYLPEQRDIEALKHAAETCRGCSLFADATQTVFGNGHPGAPIMLVGEQPGDQEDRAGAPFVGPAGRLLARALHDAGIDPGLTYQTNAVKHFKFTRKDGKRRIHQKPGRTEIVACRPWLIAEIEAVHPRVIVCLGATAAQSLLGTSFRVSTQRGQPLKLPASPEVIPDVAPEPVLVATVHPSSVLRDRSERHDEVYRLFVDDLRSARSALG

SEQ ID NO: 4692 - protein, 210 aa, Mycobacterium paratuberculosis
VARVAATRARNSPARRTRADGRDSMAPTAIKSPTDVVDFLVSQHQQIKAMFANTLAASGKAREEAFIELRRLLAVHETAEEEIVHPRAKRKIAGGAGVVEERLHEEHEAKTALQKLEKLDVDSEEFTRELTKLRDAVIDHAEHEEHDEFAKLGQELSGDELERMGRAAKLAEAIAPTRPHAGVESQLANLAAGPFAAMLDRARDVIVGKG

SEQ ID NO: 4693 - protein, 374 aa, Mycobacterium paratuberculosis
VAVARRGMPWKNRAGGKSCARELGPGVVLRGGALTGVLAVSVGALVMSVACSRPGAATESAPELTVWPVGTALHQPVWSYRGHALVAVTEDQRVAEVAEDRAAAATTRLSAPLAAGRNLQISTKDPAVVFVPQPARGRVAVVDLQSLRQVGDFDAGPAPAYLSEDAGLRMLLALSSDGRSVTPVDQYGYRKLATAPIAGAPAEVIDGANRGREIDYHVYAPSGIRHYQGPDSPAPQRGSLDIDVAVSAGDGTAVTRSYVAGHDDAVLYAVDSRRGGQGIEVLASTRLPAPIRALGTDDTRIYAATDRQLVTLETASFTGFPARHIPVLRTVDYRSALPESARRAPLSGMAVGPHRVYLTLAQAPFVVGIAKPRL

SEQ ID NO: 4694 - protein, 333 aa, Mycobacterium paratuberculosis
VTNQQDPYWRNPLSYDPLGRVPPPEPEPVGPPPAQPATLAPPYRPGVNTLATLSLVFAFLFAPAGAVLGHLGLAQIRRTGELGRDRALVGVTLSYVFILLAVVALAGWATLGGSTAAHRAAHEATTSAGPPPPTVPPDTITTLLPGLDALRNITADANLDVGPTWNSPGRSAQDGSIDRPECWGSIAAGSPDAYTPGAFTGYHAGEFTDTRSMLKSIQVIQGVAAFRDAPGAQAQLDALLAGWRQCGGSTVTVTAPGGQPIAMALSTPADAGNGITTLDLTPKGIQVRSARAVAAKANVVVDLNVSASGTTDSERARLAAVSIANYILGKIPG

SEQ ID NO: 4695 - protein, 324 aa, Mycobacterium paratuberculosis
MKYVDVDGVGRLSRIGLGTWQFGSREWGYGDSYAADAAGDIVRRALALGVTLFDTAEIYGFGKSERILGDALGEQRAEVAVASKIMPVAPFPAVVRQRARASARRLGLDRIPLYQVHQPNPVFPDSVIMPGMRDLLDSGEIGAAGVSNYSLQRWRKADAALGRPVISNQVHFSLAYPKALKNLVPFAERENRIVIAYSPLEQGLLGGKYGVDNRPGGVRAVNALFGTENLRRIEPLLQLLRDVAAQVDAKPAQVALAWLISYPGVVAIPGASSVEQLEFNVAAADIELPAESRDALTDAALAFRPTSAARFLTDLARERIPGRG

SEQ ID NO: 4696 - protein, 271 aa, Mycobacterium paratuberculosis
VAAAGSLQERANMSRTVVVGASSGLGRCIGVGLAQRGDRVALLARRRQRIEAAAKDAGPGAVAIECDVTDQASCASAIGEAADALGGIDNIVYTPAVGPLVRMVDTDADTWRRIFDTNVIGASLVTAAAVPHLSASAGKAVYLSSDAGAFGPPWPGLGAYGVSKAALERLVEAWRAEHPDIGFTCLIVGECAGGEGDGQTGMNQGWDMDLAMKAVPLWSSRGCMPGKLMPVEDLIDVVHTILRTNASTSMPLVVARGAPASQAAFAEANQS

SEQ ID NO: 4697 - protein, 716 aa, Mycobacterium paratuberculosis
MTSAKAAAPTPTGEVWPGKAYPLGASYDGAGTNFAVFSEVAERVELCLFDGDGTESRVALPEVDGFVWHAYIPGIEPGQRYGYRVHGPYDPAAGQRCNPNKLLLDPYSKAVDGTFEWNQSLFGYNFGDPDSRNDDDSAPSMPKSVVINPYFDWGNDRPPDHHYADTVVYEAHVKGLTQTHPDIPEQMRGSYGAVAHPVIIEHLQSIGVTAIELMPVHHFANDSTLIEKGLSNYWGYNTIGFFAPDTKYSSAATPGGQVQEFKAMVRSLHEAGIEVILDVVYNHTAEGNHLGPTLSMRGIDNAAYYRLVDDDKRYYMDYTGTGNSLNVGHPHALQLIMDSLRYWVTEMHVDGFRFDLAATLAREFYDVDRLATFFELVQQDPTVSQVKLIAEPWDVGPGGYQVGNFPPQWTEWNGKYRDTVRDFWRGEPATLDEFAYRLSGSADLYEHTGRRPVASINFVTAHDGFTLRDLVSYNEKHNEANGEDNNDGESHNRSWNCGAEGPTDDEQVNALRARQQRNFLTTLLLSQGVPMICHGDELGRTQNGNNNGYCQDNELTWIDWANADVDLLAFTRVVSALRAEHAVFRRRRFFSGKPVGRRGQDGLRDIAWFTPDGTEMTDEDWGANFAKSVTVFLNGHGIPDRDARGQRLLDDSFLLCFNAHHESIEFTLPPKEFGASWQVVVYTGPEETTPADEVPGAGVLNVDAHTAVVLRAPDGG

SEQ ID NO: 4698 - protein, 393 aa, Mycobacterium paratuberculosis
MKAVTWHGKRDVRVDSVPDPKIEQPTDAIIEVTSTNICGSDLHLYEILGAFMKPGDILGHEPMGVVREVGTETGDLRVGDRVVIPFQICCGSCYMCGQQLYTQCETTQVRDQGMGAALFGYSELYGEVPGGQAELLRVPQAQFTHIKVPVGPPDSRFVYLSDVLPTAWQAVAYADIPDGGTVAVLGLGPIGDMAARIADHLGYRVIAVDLVPERLGRAAQRGIHTIDLARLDAGLGDAIRDLTDGRGADSVIDAVGMEAHGSPAAKLAQQVAGVLPDALGKRLMQTAGVDRLSALYSAIDAVRRGGTISLIGVYGGMADPLPMLTLFDKQVTLRMGQANVKRWVDDIMPLLTDDDPLGVDDFATHVLPLERAPHAYEIFQKKQDGAVKVILKP

SEQ ID NO: 4699 - protein, 245 aa, Mycobacterium paratuberculosis
LPPDGSGGDVMREASTTIVTQLVELVTSLERENSDTAAGLYELIDNGVHHVTGSQYAGITLAEKSKSVNSVAATHRYPMVLDAIQNKYGEGPCLAAAWEHHVMHIADLAAEQRWQRYRRHALEQTPIRSILSFELFVDRTSMAALNFYADPPHAFTEESVELGTVYATHIALAWSMMRRQDQFRSALASRDIIGQAKGVIMERFDLDAVEAFELLTRLSQQSNTRVVDIAAALIDSEHPLKQRRR

SEQ ID NO: 4700 - protein, 434 aa, Mycobacterium paratuberculosis
VTSIVIVGSGFTGFTCARRLAKTLRRAPVDITMISPVDYMLYTPLLPDVAGGVVDARFVAVPLANSLRGVHAVRGRVDAVDFTGRTLTYRDPEERSHSMSWDRLVLTPGSVTKLFDVPGLARHARGLKTTAEALYLRDHFVEQLELANIEDDPRVAAARRTVVVVGASYSGTELVAQLRALADAAARQMGFDPGAVRFLLLDLAEQVMPEVGKKLGDAALKVLRRRGIDVRLGTTLKEAHADHVVLSDDSRIDTHTIAWVTGVTGAPLIQDLRLPTEKGRLKVQPDLQVPGHPGVFAAGDAAAVPDLTQPGKITPPTAQHATRQGKVLARNVAASLGHGSAKEYKHRNLGLVVDLGPRYAVANPLNIHLSGLPAKAVTRGYHLYAIPRGVNRWAVSLAYLTDALFARSVVSIGLSSEDDAQFTASEGIPMPKTG

SEQ ID NO: 4701 - protein, 198 aa, Mycobacterium paratuberculosis
LRRSSPGTRRAMPSKPRGEAMGELADTGAQVVDGARREAQAYRGDNPRPLGGYLAVLVVYGLVVTAATLAALASGRSLPTRWRAQDLLILTLGTHKLSRTLTKDAVTSPLRAPFTHYAGTGGPAEVQEEVREQSQLRHSLGELLTCPFCLDMWVATGFAIGLVFAPRYTRLVAGVFSVLTGADFLQLGYAIAQQAAQG

SEQ ID NO: 4702 - protein, 120 aa, Mycobacterium paratuberculosis
MADRRGNAGAPASDQGVYGISVAAELSGIAVQSLRLYERHGLVTPARSQGGTRRYSADDLARLKRISKLVDAGVNLAGVARILALEDDNATLSAANTDLRSTNRALREAAKTADGDAATG

SEQ ID NO: 4703 - protein, 147 aa, Mycobacterium paratuberculosis
MLMRSDPFRELDRLTNQVLGTATRPAVMPMDAWREGEHFVVEFDLPGIDAESLDIDIERNVLTVRAERPALDPSREMLATERPRGVFSRELVLGDNLDTDKIEASYRDGVLSLHIPVAEKAKPRKIAVGRGEAPRAVTETAREVVNA

SEQ ID NO: 4704 - protein, 268 aa, Mycobacterium paratuberculosis
ARRRAAAARARRFRAPVARLRLQGSGVHLSPGEPSEREGLTMTWNLDGQTANVEQALAGGHTQPAGWFRFYFADQRWEWSEQVQRMHGYEPGSITPTTELVLSHKHPDDRARVAATIDEIVTNHQAFSTRHRIIDTAGNVRHVVVVGDRLTDEQGEVIGAQGFYIDVSTPHEQVQEEMMSARLAEISRNRARIEQTKGMLMLIYGISDSAAFELLKWLSQEGNVKLRPLAEQIAEDFRGADVPLPTRSEFDHLLLTAHQRLKASDTRS

SEQ ID NO: 4705 - protein, 551 aa, Mycobacterium paratuberculosis
VTGNRFDELAAARDQTEKLLRVIAEIGAGLDLDATLHRIISAARELTSAPYGALAVRDRHANLISFVHEGMDAETVRRIGHHPVGKGLLSLSLLDTPALRMDDLTAHPAAAGFPEHHPAMRAFLAVPITIRGAVFGNLYLTHVDEARVFSDADEMAARALAFAAAVAIDNAQVFERERMSVKWIEASREITTALLSRTEPHRRPMQLIAERACALTDAEQAIVLVPADPEQPGNPEVDTLVVLAAVGLPAADVLGQRVPVRGSTSGAVFKSGEPLITDEFRYPIQAFTDAGRRPAIVMPLRARDEVVGVIAIARGTEQPPFDESYLDLVRDFATHAAIALVLAAAREDARQLAVLAERERIAHDLHDHVIQRLFAAGMDLQGTLARARSPEVADRLNRTLDDLQTIIEEIRTTIFALRSPAAVAGDFRHRIQRVIAELTENRDLVTTVRMDGPMTAVGAELAEHAEAVTAEAVSNAVRHSGASRLTVQIGVADMFTLDVIDNGRGIASGNTRRSGLANMTRRAEQLGGSCEISSPPGGGTRVHWTAPLLDH

SEQ ID NO: 4706 - protein, 222 aa, Mycobacterium paratuberculosis
MVKVFLVDDHEVVRRGLCDLLSSDPDLQIVGEAGTVAEAKARIPAARPDVAVLDVRLPDGNGIELCRDLLSEHPDLRCLMLTSFTSDEAMLEAILAGASGFVIKDIKGMELARAIKDVGAGKSLLDNRAAAALMAKLRGSAAQADPLSGLTEQERTLLGLLSEGLTNRQIAARMFLAEKTVKNYVSRLLAKLGMERRTQAAVFASKLNQQAGRPPTPPDWPG

SEQ ID NO: 4707 - protein, 191 aa, Mycobacterium paratuberculosis
LRVGALVQRLWSRPQRTFGRRTDTGPANSVAAVTHCGSDSLRLNTAGAERDEAMPATDDGVEILPVRECWDLLRGLTLGRLVTHADGQPDIFPVNYVVQRRTVLFRTAEGTKLISAAINNRVLFEVDDHNVVGAWSVIIRGIARSLRTPEEIEEAERAQVLPWTRSEKTHYVRIVPESVTGRRFRFGSPAG

SEQ ID NO: 4708 - protein, 324 aa, Mycobacterium paratuberculosis
MNTGFPDPETVRTALALASRAPSVHNTQPWRWRIDPAGLHLYADPARQLPHTDPDGRDLILSCGIALQHCVTAFAAVGWRSRVRRLPDPDDPDHLATLEFSPQTADYVDVALAAAIPRRRTDRRHYSCWPVPVGDIALMAARAARAGVTLYQVQDVDGLHDIVAQSIRDHLTQDYLAELTTWSGRYFSVSGVPARNTPFPDPAAKIPTRLFAGAALPMAQGSSAADDNAVVLALGTRHDDRLARLRAGEATGVVLLTATSAGLASCPVTEPLETPQTRAAVRADIFGDGHHPQMLLRVGWAPINADPLPATPRRDLADFVEWVG

SEQ ID NO: 4709 - protein, 386 aa, Mycobacterium paratuberculosis
MLTTMANHGPDPTTPLWRAAQVFRLLSCVYATGFQIAINPDLLRPVLGWVLFAGLIGWRAASALAYLRGFGRKPAWVLAELVVVVLLMWSNNLVASPHWAADNQTWPTTLWASNPTISAAIQFGPVGGMLTGLAVMTANFAVKNYFALNLGHNATVIIELAIGMAIGMAAQTARRAHDELQRAARLTAAAQERDRLARQVHDGAIQVLALVAKKGHEIGGATTELADLASEQERALRRWLACTDIDRDADGDTVDLRTLLRRRDSDRVSISLPGTPVRLGRWAATELDAAVGNALDNVVAHAGPGAHAFVLVEDLGDSVLVSVRDDGVGIAAGRVEEAARQGRLGISQSIVGRLASLGGTAELHSEPGAGTEWELCVPRREGRDDG

SEQ ID NO: 4710 - protein, 221 aa, Mycobacterium paratuberculosis
MTDDATPTTVMVVDDHPIWRDAVARDLAESGFAVVATADGVTAAQRRAGVVRPDVVVMDMQLPDGDGAQATAAVLAVSPSSRVLVLSASDERDDVLQAVKAGAAGYLVKSASKAELAQAVTDTAAGRAVFTPSLAGLVLGEYRRIAQSKDDGPTRPRLTDRETEVLRYVAKGLSAKQIAEKLSLSHRTVENHVQATFRKLQVANRVELARYAIEHGLDEEP

SEQ ID NO: 4711 - protein, 444 aa, Mycobacterium paratuberculosis
MTTPVRFPDAAEVAARTPADRDRVLDVIRIVSLGGVVLGHTVMAASIIRDHVLIWDNLLTTSALFQAMTWLLQIMPLFFFAGAAACVSSWTPGTDWGGWLMRRCTRLFRPVFYYLVFWAVMLTVLYQALPQHIYEPIAGVSTQLLWFLGAYVLVLAAMPVLYRITTTGRLAAGVAAVYGAIALIDVIRLHWPAMMPLGYLNLAIWLIPAMFGVAYRRGLLGGRAALAVAAAFFAADVALVHWGPYQLSMVGTGDHHLSNTSPPSLLLAGHAIILSALAIAAAPAIARWAQRPRVWWWTAIGNSGAMTLYLWHMPVLLGVHLAFDYLGCPRFPGAPDFLAISVAQVLLVVVAVAVLFVALRPLENNPLSGWDGAPAVMSRGWGAAVGALLCLAGIALLAAIRWGLKDDGLVCMAVVVAALVAARIVAQHAGPAGHGSSSRPCSMA

SEQ ID NO: 4712 - protein, 104 aa, Mycobacterium paratuberculosis
VRCRRLIRMTVPHTMPKTTAAFFVQAAVAFAISFVAALGGIYFLPLDPWPRLFLGVTFLFLVSSAFTLAKVIRDQQEAATVRVRLDEARIERLLADYDPLNTAN

SEQ ID NO: 4713 - protein, 427 aa, Mycobacterium paratuberculosis
MPKKSLPVQARPEPGSGEYVLGPWRAAALSMAVIAPAAWYGLGALLGAAVMIPVIYALARLRRHAPQARSTAELIGATLGRKAGTAAGIVQLLAYLVLAAQFAATLGLQLLQLLSPGDDPAAIVSWLPVGAAAAALVVGAAACWASTRAVASLAMPLVLAGLLLYVCLAVAVTALVTLSTDPVVIGSAATPRPLSGQLVGFGLGMVGVELLTVRTPRIARPGRSMSLATAVVAAAAVVLWVGDHRGVAGPWRWSATMLAEAVPEFYTDEGRRWMAAAGIALAVAAALVTGWAATRTAAGLAAMRGATPNAGLRLAVMGLVAVVAVVVSAHGMRSIGMVILGAAPLLLMALYVLVAEANSRIPGDSVVAWWVRLVMPALAVVAVVKPLVDSQFAPVQVATVAAAAIGVGAAGAAPLLARHRERTAKSE

SEQ ID NO: 4714 - protein, 351 aa, Mycobacterium paratuberculosis
MTDTVKVSVDRSSVAMGDDVESHREFWVFPESATVDDLLVEISSHFLPGIAGPAGWRVYLGTRRDERQEIGLIYTRDDLGQQDQICRLSAGKTTLGELARRTGLPELDVYASYLTFDRARPLALDEITGGPTFTGCRPDKLESEAAADAKRDWVMLRELDRRAAAVAGTRRDWVRRTLLAAPPPWIDVFIARNFHYLTELHCPASMALAAKLLGVNESPPEDFAARAHADVRPNVVILAMVLAAFEWGTERDTWRVGERPHRKAYLELLAHCGYRLSPIEQVMAGHIGIEQLKLSEADSARLDRIRQLRDQQHQLRMSRYYTKTLSEEQYRAAIEPVHAELSSLGELPGPM

SEQ ID NO: 4715 - protein, 392 aa, Mycobacterium paratuberculosis
VQNERVQGFGFHTLALLTAVGFAGPLLASAKRFRIPVVIGELIAGLAIGRTGFGVVDVADPTFQLLANIGFALVMFVVGTHVPLRARLMRSALPAALARATLAGGIAAVLGVALAVQFDTGHAALYAVLMASSSAALALPVIDSLRLRGPRVLSVTTQIAIADAACIVLLPLVIDIRRAPTATLGSLAVAGCAAALFVLLRAVDRKGWRRRLHAYSEQHRFALELRTSLLVLFALAALAVATQVSIMLAGFAVGLVVGAVGEPHRLARQLFGITEGFFSPLFFVWLGASLQVRELGAHPQLILLGAGLGCGAVLAHCAGRLLGQPLTLAVLSAAQLGVPVAAATIGTQQHLLAPGEASALMFGALLTIAAASIATGLAARRQGAPEPGEPAK

SEQ ID NO: 4716 - protein, 362 aa, Mycobacterium paratuberculosis
VRMTMAQAIWENIPADLYGRRKRDRMYTALYGVGALFGGLASASRWTPARVVPVRRTTTAVVTQREELAPDVVAFTLADPHGGLLPSWTPGAHIDVRLPSGRRRQYSLCGPPGRRTDYRIAVRRIEDGGGGSIEMHDTFRVGDALEFEGPRNAFYLVTDERDVLFVIGGIGVTPILPMIQTAQQHGINWRAVYAGRSRDDMPLLDEVVAVAPERVSVWADDERGRIPTAADLLAEAGPATAVYVCGPTAMLEAVRTARDEHADAPLHYERFGPPPVVDGVPFELELARSRRVLTVPGNRSALEVMLDRDPATPYSCQQGFCGTCKVKVLAGQVDRRGRTVEGDDEMLVCVSRAKNDRLVIDA

SEQ ID NO: 4717 - protein, 309 aa, Mycobacterium paratuberculosis
MTTEVASTTVTATDGVRLAVHTYTGIDPARPTVLAIHGYPDNHHVWDGVAGVLRRRFNVVAYDVRGAGQSSTPPERSGYRLDQLVADVDAVIGRLGVDSVHLLAHDWGSIQGWAAVTDESVMGKIASFTSISGPHLNYAGRFLRSARTPGGVLDVVKQILASSYIWFFLAPSAPEWAIRSGATVKVFEAVERIGGSTAGAQRGAGYRSTDDYLNGLNLYRANMPGPILSPPARLPQTSVPVQVIVARRDYFVSPALQRFTGSIPDGSRVVPIDGGHWVVNSHPDVIARLTGDWVDLTTRPAGGHHTGQT

SEQ ID NO: 4718 - protein, 302 aa, Mycobacterium paratuberculosis
MFTVDDKATGPHDAALDHERIVLQARDVDFDWSALPFYYVPGEPFTTHFCNVLHLLLPAGEEFIVEAFKDTLPLIKDDQLRRDVQGFISQEAMHSQAHAGVLGHFAAKGIDVTPFTDQMRWLFGQLIGDRPRWSPRRRQSWLLERVSMVAALEHYTAILGEWILDTPQHDALGTDPVMLDLLRWHGAEEVEHKAVAFDTMKHLRAGYWRQVRTQLLVTPALLWLFIRGVRFMYSVDPHLPPGSKPRWRDYFSAARRGLVPGPFEFLRVIGAYYTPGFHPSQLGGVGRAVDYLARSPAARAAH

SEQ ID NO: 4719 - protein, 1115 aa, Mycobacterium paratuberculosis
LLRTGRRDYIGFIFMIASRTRLSPAWKGDSSTMETLIDYLHLWEQRRPEQTLFRFVDVDGRELEHYTYRSFAERTRELAAYLSTEAGLRAGDCALLVYPPGLEMVAALYACARIGVIAVPVSPPLPMSFESGLAKLGFIARDCQARAVLSTKQFEYDFRMLLGQRHGGQPWSDAGLPELPWFATDGAQEFGGAPVPDTPGDVLFLQYTSGSTSDPKGVIVSHENVIANVSAFTGGSEVLVSWLPQHHDMGLISAYMFILLQGGTTHAMSPLDFLARPSAWLRLISDVRATHTPVPNFALEYCLREDKVPAAELAGIDLSSLECIVVGAEPLRANTFHQFRERFAPYGLRPEALTGAYGMAESTLIVSIRGRQTLTVNKRGLEKNVARVEKALPENSNQVPLVSCGKPLEETVVRVVDPQTRQALGEGRVGEVWLAGPSKGRGYWNRPQLTAEMFEARLAGDDEHSYLRTGDLGFLYEGELFVCGRSKDLIIVRGVNCYPSDIEAVVERSAKQVRGGCVAALSVEQDDQEALVVVAEVRDEHNLPDARALARAIRRHCHIDPHTIVFAPPRSIPKTTSGKIRRASTRQLWLDGALPTFSSWVNPAATRGHDGTAAGAGPLERFANLIESYDLTGDEDCSFADLGIDSLALAELRNDMQALLAEHGAAELADEVNTRLLQRLTVAEFFSLIRQFGEGSGQPLDALRRALDQISAEYEAHEAAQMRADAALPLPDPAPARAGTPTDILLTGATGFLGPFLLSSLLARTPYTVHALVRATDPGHGLDRIVASLRKAQLWTPALEAEVRARVRVICGDLAEPALGIGEPAFARLARDVDAVVHNGALVNYVRTYDALRPTNVEGTRELLRLAMTDHAKTFHLVSSTFIYGWSTQPVVGEWDANEKMAGLDFGYSQTKWVAEQLALAAQRKGLDVRIYRPSLISPTRSGFGSQDDILVRLTAFMIEHGLAVNALNQISLLPADLIADHIVALMDLPDESGSVFNMTADDYYNLTDVTRILSERYGYRFDYHDIDSFAEQLNRRCTPDDQMYPLVDFLTRSADKIAAMRDKRYDNTQYRHRRGLVPVRLREPALTETVDHLVRFLRTERMITEVEDEAQRSA

SEQ ID NO: 4720 - protein, 354 aa, Mycobacterium paratuberculosis
VFCQVRAGDRRMYLGVIVNPKARRNRGASPARIAELRRIVGPWGEVHETASIEELRDTLGRIGPRVTHLVGDGGDGALHWLINEIERGVADPDSWPAFVPTNGGSVNAVARKAGVRGHPEAIIRALVAAAESDRPPAEVRLDTLRLDGATADGAAFHRLCFGLAAGGVGNRFYDRYYDAPDHGRLAVARVIARSFGDYITSKVAPSRVRTPNYASILFTPTLARVVIDGDEVPSRTHRLLHAGAIDLRIGGPLRLFPKAAQPGALHFQAGDLRPSKIVVQLPLALTNGMLRGAELRDVTGHEMIIEALDEPLSPIIDGERFVGIVQLVARAGPRIRIAPVGSATVGRARAVAPT

SEQ ID NO: 4721 - protein, 367 aa, Mycobacterium paratuberculosis
VSADRPNRHLTVKEATSMVVVGADVHKRTHTFVAVDDVGRKLGEKVVAATTAGHAEAVMWARERFGTEVVWAIEDCRHLSARLERDLMGFGQSVVRVPPKLMAQTRASARTRGKSDPIDALAVARGFLREPDLPVASHDEVSRELKLLVDRREVLVAQRTATINRLLWRVHELDPDHAPKAGSLDLAKHRRILGDWLVTVPGLVAELARDELADITRLTETINALAKRIGERVRVVAPVLLSLPGCAELTAAKLVGEAAGVTRFKSEAAFARHAGVAPIPVWSGNTAGRVRMTRSGNRQLNAALHRIAVTQIRLDGLGQTYYRHRIAVSGSKTEALRCLKRRLARVVFHHLHTDHQNRIQPCQPAAA

SEQ ID NO: 4722 - protein, 293 aa, Mycobacterium paratuberculosis
MPDWTAAQLPSFAGRTVIVTGANAGLGEVTARELARVGGHVILAVRNTDKGRAAADRMAGVATGRVEVRELDLQDLASVRRFADGIDTVDVLVNNAGIMATKHAVTVDGFEGQIGTNHLGHFALTNLLLPKLTDRVVTVSSLMHHFGYISLKDLNFRSRPYSAWLAYSQSKLANLLFTSELQRRLDAVPSSLRALAAHPGWSHTNLQGNSGRKLGDAAVLAVDRIVSTDADFGARQTLYAVSQDLPGDTFVGPRFGLYGRTQPTWRNWPAKRAGTAAALWELSEELTGTKFPL

SEQ ID NO: 4723 - protein, 305 aa, Mycobacterium paratuberculosis
MSDANLAAVLALCAALASAVGNVVRQRSAQEVTDKPVGHLALFGMLLRDTRWWLGGLGDIGSYVLLAAALDRGSVLLVMSLQVTALLFALPIYARMTHHPITGREWAWALLLAVALAVLIAVGDPTGGQQRAPLQTWLVVAAVIGPLLVLGLLGARVWADRPVAALLLAAVAGSLLAMFAVLMKGVVDILEHNPGQLWRSFELYALVFCGVAGMIYHQSAYRAGALTASLPTIIVAKPVVGGILGIIVLRETLVAGGWEWVVLAVTAVVVIVATVGLARGEAASMSAGAGRDVRPTDRPKAAYQA

SEQ ID NO: 4724 - protein, 441 aa, Mycobacterium paratuberculosis
VRSRDANSDSLMQINSQRIPPYKLLAVAVLLVLSLILALIYGQFRGAFTPKTSLTMLASRAGLVMDPGSKVTYNGVEIGRVGTISETVRDGKPAAKFTLEVYPRYLKLIPSNVNADIKATTVFGGKYVSLTTPAHPSPQKITPHTIIDARSVTTEINTLFQTITSIAEKVDPVKLNLTLSAAAQSLSGLGEKFGQSVVNANALLDDVNPRMPQARKDIQGLAALGDTYADASPDLFDFLNNAVITSRTINAQQKDLDQALLSAAGFGNTGADLFTKGGPYLARGAHDLVPTAQLLDTYSPEIYCLMRNEHDALPATGAAEGGFNGYSLNMNTEALSGLGLIANPVSAVPVIASMVGGIVGVVGGAPNPYIYPENLPRVSARGGPGGAPGCWQKITRDLWPAPELIMDTGNSIAPYNHLDTGSPYALEYVWGRQVGDNTINP

SEQ ID NO: 4725 - protein, 205 aa, Mycobacterium paratuberculosis
VLGEGSNMRSFSVAAFAAALVLVGPAGAAAAPKDYCADLKGANTGQTCQIQMADPGYNVDISFPANYPDEQPVADFISKQRDDSPARAGEADVGERDRDGAGKVAGDRRVDGTDHGGEQQRGHRPSGQQRPALLPAAQPTDQCGGHRRQHRAAQQPVQPRVARTAQARLDRVDADQPQECDQADRMPAPRRGLGRETAGHSPRIR

SEQ ID NO: 4726 - protein, 993 aa, Mycobacterium paratuberculosis
VGMRPTARMPKLTRRSRILILIALGVIALLLAGPRLIDAYVDWLWFGELGYRSVFSTVLVTRFVVFLIAGLLVGGIVFAGLAVAYRTRPVFVPSNDNDPVARYRALVLSRLRLVSVGVPVAIGLLAGIIAQSYWVRIQLFLHGGDFGIKDPQFGKDLGFYAFELPFYRLLLSYLFVAVFLAFVANLLAHYIFGGIRLSGRTGALSRSARIQLVTLVGLLVLLKAVAYWLDRYELLSHTRGGKPITGAGYTDINAVLPAKLILMAIALICAAAVFSAITMRDLRIPAIGLVLLLLSSLIVGAGWPLIVEQISVKPNAAQKESEYISRSITATRQAYGLTSDVVTYRNYTGDAQATAQQVADDRATTSNIRLLDPTIVSPAFTQFQQGKNFYYFPDQLSIDRYLDRNGALRDYVVAVRELNPDRLIDNQRDWINRHTVYTHGNGFIASPANTVRGIANDPNQNGGYPEFLVNVVGANGNVVSDGPAPLDQPRVYFGPVISNTSADYAIVGRNGADREYDYETSTETKNYTYTGLGGVPIGDWLSRSVFAAKFAERNFLFSNVIGSNSKILFNRDPARRVEAVAPWLTTDSSVYPAIVNKRLVWIIDGYTTLDNYPYSELTSLESATADSNEVAFNKLAPDKRVSYIRNSVKATVDAYDGTVTLYQQDEQDPVLKAWMQVFPGTVKPKSDISPELAEHLRYPEDLFKVQRMLLAKYHVNDPVTFFSTSDFWDVPLDPNPTASSYQPPYYIVAKNIAKNDNSSSYQLTSAMNRFKRDYLAAYISASSDPATYGRITVLTIPGQVNGPKLANNAITTDPAVSQDLGVIGRDNQNRIRWGNLLTLPVGQGGLLYVEPVYASPGASDAASSYPRLIRVAMMYNDKIGYGPTVRDALTGLFGPGAGAAATNIQPTEGGAPAASPPANAPAPAVTPGSAPPVAAPPVPDGSVTLSPAKAAVLQEIQAAIGAAKDAQKKGDFAGYGAALQRLDDAITKYNNTK

SEQ ID NO: 4727 - protein, 340 aa, Mycobacterium paratuberculosis
VNRRILTLMVALVPIVVFGVLLAVVTVPFVSLGPGPTFDTLGEVDGKQVVAIEGTMTHPTTGHLNMTTVSQRDDLTLGEALTLWLSDTEQLVPRDLIYPPGKSREDVDKANNADFKQSEDSAAYAALGYLKYPSAVTVAKVPEPGPSAGKLKVGDAIDAVNGTPVATVEEFTGLLKNTKPGQTVTIDYRRKNEPAGVAQITLGANKDRDYGFLGVAVLDAPWAPFVVNFNLANVGGPSAGLMFSLAVVDKLTTGDLAGSNFVAGTGTISADGKVGQIGGITHKMVAAHAAGATVFLVPAKNCYEASSDNPSGLRLVKVETLAQAVDALHAITAGGQPPSC

SEQ ID NO: 4728 - protein, 459 aa, Mycobacterium paratuberculosis
VSTVEVMADLPFGFSSGEDPDKPGKKDPDSGSNPSDPFAAFGISGEFGMGDLGQIFTQLGQMFSSAGSASAGGSDSGPVNYELARRVASNSIGFVAPIPATTNSAIADAVHLAETWLDGATALPAGTAKAVGWTPADWVDNTLETWKRLCDPMAQQISTVWAASLPEEAKSMAGPLLQMMSQMGGMAFGSQLGQALGRLSREVLTSTDIGLPLGPKGIAAILPDAVESFASGLERPRSEILTFLAAREAAHHRLFSHVPWLASQLLGAVEAYAMGMQIDMSGIEELARDFNPASLSDPAAIENLLGQGVFEPKATPAQTQALERLETLLALIEGWVQVVVAAALGDRIPGAAALAETLRRRRASGGPAEQTFATLVGLELRPRKMREAAALWERLTEAAGVDARDGIWQHPDLLPDADDLDDPAAFIDRVIGGDTSGIDEAIARLEQEGPDSPGSGGDT

SEQ ID NO: 4729 - protein, 289 aa, Mycobacterium paratuberculosis
VPAAAVSTPAATYALDPAMPVLLRPDGAVQVGWDPRRAVLVRPPRGLAAAELATLLRSMCSPTPLSELQRRALEHGLTDADGLRNLVTQLVGAGVASECGRSGGRAPSVRIHGRGPLSELLVESLRCSGARIAHSSQPHAAVSGDDVDLVVLSDYLVADPRLVRDLHEQGVAHLPVRVRDGVGLVGPLVIPGVTSCLSCADLHRRDRDAAWPVICAQLRDTVGVADRATVLATAALALSQVNRVIAAVRGQPAASDPAPPQTLNATLEFDLHAGAIVARRWDRHPLCSC

SEQ ID NO: 4730 - protein, 447 aa, Mycobacterium paratuberculosis
MDDGYVSDIKRGRAARNAKLASIPVGFAGRAAIGFGKRLTGKSRDEVQAELLEKAANQLFTVLGELKGGAMKVGQALSVLEAAVPEEFGEPYREALTKLQKDAPPLPAAKVHRVLDAQLGTKWRERFSSFDDTPVASASIGQVHKGVWSDGREVAVKIQYPGADEALRADLKTMQRLVGVFKQLAPGADVQGVVDELIERTEMELDYRLEAENQRAFAKAYQDHPHFAVPRIVASAPKVVIQEWMQGIPMAEIIRHGTTEQRDLMGTRLLELTFDAPRRLGMLHGDAHPGNFMLLPDGRMGVIDFGAVAPLPDGLPVELGMTIRLARDKNYDLLLPTMEKAGFIQKGQQVSVRDIDDMLRQYVEPVEVEVFHYTRKWLQKMSAIEIDRSVSQIRTARQMDLPPKLVIPMRVIMSVAAILCQLDAHVPIKALSEELVPGFAEPDNAIV

SEQ ID NO: 4731 - protein, 91 aa, Mycobacterium paratuberculosis
DMSAPTVSRQALPCHVGDPDLWFAEAPADLERAKQLCAGCPVRRQCLAAALERAEPWGVWGGEILDRGAVLGFKRPRGRPRKDGRRAGAAA

SEQ ID NO: 4732 - protein, 703 aa, Mycobacterium paratuberculosis
MPTLADPLTAGLDDEQREAVLAPRGPVCVLAGAGTGKTRTITHRIAQLVAGGHVAANQVLAVTFTQRAAGEMRSRLRVLAAAAGTDAAVGSVSALTFHAAAHRQLRYFWPRVVGDTGWQLLDSKFAVVARAASRTRINASTDDVRDLAGEIEWAKASLIGPEEYPAAVAAAGRDIPLDAARVAGVYAAYEALKARGDHVTLLDFDDLLLHTAAAIENDPAVAEEFRDRYRCFVVDEYQDVTPLQQRVLAAWLGDRDDLTVVGDANQTIYSFTGASPRFLLDFSRRFPDATVVRLERDYRSTPQVVSLANQVIAAARGRVAGSKLHLVGQRPPGPVPTFHEHSDEPAEAAAVAKSIARLIESGTPASEIAVLYRVNAQSEIYEEALTEAGIPYQVRGGEGFFNRQEIKQALLALQRAAEREGEDAREEPLPAVVRAVLEPLGLTAEEPVGTRARERWEALRALAELVDDEVARRPQLDFAGLLTELRMRADARHPPVVQGVALASLHAAKGLEWDAVFLVGLADGTLPISHALAHGADSEAVEEERRLLYVGITRARTHLALSWALARSPGGRQSRKPSRFLNGIAPQTRAEAAPARSRRNRSTATRCRICNNNLTTPAAVMLRRCETCAADIDEDLLVRLKAWRLDVAKEQKVPAYVVFTDNTLIAIAELRPGDEQALIAIPGIGARKLEQYGPDVLELVRGR

SEQ ID NO: 4733 - protein, 84 aa, Mycobacterium paratuberculosis
MTSAPLTVYTTSWCGYCHRLMTVLKSNGIPYEAVDIEHDPAAADFVSSVNGGNKTVPTVKFADGSTLTNPSAAQVKAKLAEAGN

SEQ ID NO: 4734 - protein, 310 aa, Mycobacterium paratuberculosis
MAIADFQLRSVPLLSRVGADRADQLRTDVEAAAAGWADAALLRVDSRNQVLVADGRVVLGAAAELGDKPPPEAVFLGRLEDGRHVWAIRGALQAPDDPEVRAEVVNLRSLGPIFDDTSSQLMSSAVALLNWHERSRFSSVDGSPTRPARAGWSRVNPVTGHEEFPRIDPAVICLVHDGGDRAVLARQAVWPERMFSLLAGFVEAGESFEVCVAREVREEIGLTVRDVRYLGSQPWPFPRSLMVGFHAVADPAQDFAFNDGEIAEAAWFTRDEVRAALAAGDWSSDSESKLLLPGSISIARVIIESWAALD

SEQ ID NO: 4735 - protein, 357 aa, Mycobacterium paratuberculosis
VRNGRSRKLSGLNQTLAAQRGHQLVGVVRIPEEHASPIRVITRRLAIALVVLFAAAVIVYADRSGYRDLRGGSLTFLDCVYFSAVSLSTTGYGDITPYTETARLVHTLIFTALRIAFLAVLVGTTLEVLSERSRQGWKIQRWRSRVRNHTIVIGYGTKGKTAVAAILGDETTQAEVVVVDTDRSTLEHAESADLVTVHGDATKADVLRLAGAQHAASIIVATSRDDTAVLVTLTAREIAPHAKIVASIREAENQHLLQQSGADSVVVSSATAGRLLGLATTTPSVVEMIEDLLTPDVGLAIAEREVEQSEIGGSPRHLRDIVLGVVRRPAAAHRRPRGGRGRGQRPVALHPQRGALM

SEQ ID NO: 4736 - protein, 1099 aa, Mycobacterium paratuberculosis
VRPMSDRYSPRELACALGLFPPTEEQAAVIAAPPGPLVVIAGAGAGKTETMAARVVWLIANGYAHPGQVLGLTFTRKAAGQLLRRVRSRLARLAGVGLGAASPNHGAVDPEAAPVVSTYHAFAGSLLRDYGLLLPVEPDTRLLSETELWQLAFDVVNRYRGPLRTDKTPAAVTSMVLRLWGQLAEHLVDTSQLRETHLELERLVHALPAGPYQRDRGPSQWLLRLSGTQSERAELVPLLEALDERMRAVKVMDFGMQMASAARLVAAFPQVGADLRGRYRVVLLDEYQDTGHAQRIALSALFAGGVDDGLALTAVGDPIQSIYGWRGASATNLPRFTTDFPRSDGTPAPVLELRTSWRNPPRTLRVANAISAEARRRSVAVHALRPRPDAPPGTVRCALLPDVVAEREWIADHIDAHYRRARADGVSPPTAAVLVRRNADAAPIADALRARGIPVEVVGLAGLLSVPEVAELVAMLRLVADPTAGAAAMRVLTGPRWRLGARDLAALWQRARALGGAGTAGGPATAEAIASAADPRNVEADAVCLADAIADPGPAEGYSAAGYARIAALAAELSALRAHLDHPLGDLVAVVRRVMDLDCEVRAAAAAGWAGTEHLDAFADVVAGYAERADTGGTDASASASVAGLLAFLDVAESVENGLPAAPLAVARDRVQVLTVHSAKGLEWQLVAVAHLSGGVFPSTTAKTTWLTDAAELPPLLRGDRARPGALGIPVLDTSDVTNRKQLSDKISEHRRQLEQRRVDEERRLLYVAVTRAEDTLLVSGHHWAATGIKPRGPSDFLCEIKDVIDASAAAGDPCGTVEQWAPAPADGERNPLRDNAVEAVWPADPLASRRGEVERGAALVRQAMAAEPGDPGADVEGWAADVDALLAERARVTGPPPQALPGQLSVSSLVGLARDPAGAARRLRHRLPSRPEPHALLGNAFHAWVQKFYGAECLFELGDLPGAADSDVGDTAELAELQAAFLESPWAARTPVAVEVPFEMPIGDTLVRGRIDAVFAESDGGATVVDWKTGAPPDSPEAMRQAAVQLAVYRLAWAALAKVPESSVRTAFHYVRARTTVVPEALPTSDELAGLLAPTAPV

SEQ ID NO: 4737 - protein, 1044 aa, Mycobacterium paratuberculosis
LHAAMSFTWDAQAGAVLAPGVRGTVRVLGGPGTGKSSLLVDAAVAQIEAGVNPESVLLLTGSGRLPMAERSALTTALLRSAGAGPAVREPLVRTVHGYAYAVLRRAAERAGEAPPRLVTSAEQDAIIRELLAGDLADGPRAATAWPAALRPALSTAGFATELRNLLARCAERGVDPQALERLGRRCRRPEWVAAGQFARQYEQVMLLRAAVGTAAPEATTPALGAAELVGAALEAFAVDAELLAAERGRIRVLLVDDAQQLDPQAARLVRVLAAGADLALIAGDPNQAVFGFRGGDPGSLLDGAAPAVTLTRSHRCAPAVARAVSGVAGRLPGSSAGRRIEGAGPGEGSVAVRLAASAHAEAAAIADALRRAHLVDGVPWSQMAVIVRSVPRAGARLPRALAAAGVPVTAPAASGPLAEQPAVRALLTVLLATADGLDGQRALALLTGPIGRVDPVSLRQLRRNLQRANAGRPPGDFAELLVEALTGTAPPPGAPFRALRRVRAVLDAAGRCHRDGQDPRYILWAAWHRSGLQRRWLSVSERGGPAAAQAGRDLDSVTALFDITDDYVSRTSGASLRGLVEHVAALQLPGAEPVATAEQVSVLSAHAALGREWDFVVIAGLQDGLWPNTVPRGGVLGTQRLLDVLDGVSADASVRAPLLAEERRLLVAAMGRARQRLLVTAVDSDTDGSDREAALPSPFCYEIAQWAGEDAEPAALQPVSAPRVLSAAALVGRLRGVVCAPDGAVDELDRRCAATQLARLAKAGVPGADPASWHGLIPVSTAEPLRGGGDVVTLTPSTMQTLTDCPLRWLAERHGGTDPRDLRSAIGSVVHALIAQPHRSPAELVAELDRVWRHLPFAAQWHSDNELARHRAMLEAFAQWRANTRGALTEVGVEVEIDGTLSTGDGREVRLRGRVDRLERDAAGRLVIVDVKTGKTPVSKDDAQQHAQLALYQLAVAHGLLGAAGGDAEPGGARLVYVGKAAASGVVEREQDPLTAAAADQWREALRRAADATAGPQFIARRNDGCTHCPLRPCCPAHADGSGR

SEQ ID NO: 4738 - protein, 78 aa, Mycobacterium paratuberculosis
MVLQQPKEGSRTMKDERGFPIDEPPEGDVAEQQRPVDTDDETGLDTEYVSAGDREANEADVIDQAYIVSTEDEWDDDR

SEQ ID NO: 4739 - protein, 261 aa, Mycobacterium paratuberculosis
VTATLHVHRYGPPGPARILALHGLTGHGQRWQHLAGMLPEFALAAPDLVGHGRSSWSAPWTIDANISALTDLLDAQAGAPVLVVGHSFGAGLAMHLAAVRPDRVAGLLLLDPAIGLDGAWMREIAEAMLSSPDYPDAEEARLEKLHGSWSDVEPALLDAEIDEHLIELPNGRYGWRVCLPAMMSYWSELARDPVLPPAQTATILVRAKRTAPPYVGDELIAALQDRLGSRFRLLDFDCNHMVPYAKPDDVAALARELLKAR

SEQ ID NO: 4740 - protein, 100 aa, Mycobacterium paratuberculosis
VAPVTDEQVERVRALVAAIPPGRVATYGDIAAVAGLSSARIVGWIMRTDSSDLPWHRVITASGRPARHLRTRQLELLRTEGVLATDGRIPLPEVRHRFGA

SEQ ID NO: 4741 - protein, 284 aa, Mycobacterium paratuberculosis
VTVEPPPDHVLSAFGLAGVKPVYLGASWEGGWRCGEVVLSLVADNARAAWSARVRETLFVDGVRLARPVRSTDGRYVVSGWRADTFVAGTPEPRHDEVVSAAVRLHEATGKLERPRFLTQGPTAPWGDVDIFIAADRAAWEERPLASVPPGARVAPATADAQRSVELLNQLATLRKPTKSPNQLVHGDLYGTVLFVGSAAPGITDITPYWRPASWAAGVVVIDALSWGEADDGLIERWNALPEWPQMLLRALMFRLAVHALHPRSTAEAFPGLARTAALVRLVL

SEQ ID NO: 4742 - protein, 398 aa, Mycobacterium paratuberculosis
VSTPLPPLVAPADQLTADEMARYSRQLIIPGLGVDGQKRLKNARVLVIGAGGLGAPTLLYLAAAGVGTIGIVEFDAVEESNLQRQIIHGVADVGRSKAASARDSIAAINPLVDVRLHEFRLDASNAVELFGHYDLIVDGTDNFATRYLINDAAVLAGKPYVWGSIYRFEGQVSVCWEDAPDGRGLNYRDLYPEPPPPGAVPSCAEGGVLGVVCASIASVMSTEAIKLITGIGESLLGRLMIYDALEMSYRTIAIRRDPCDASRPAITTLVDYEQLCGAAPAASTDAATGGAEAAITPRQLRELLDSGAKLALIDVREPVEFDIVHLDGAQLIPQSSINSGEGLAKLPADRMPVLYCKTGVRSAQALAVVRQAGFSDAVHLQGGIVAWAQQMQPDMILY

SEQ ID NO: 4743 - protein, 366 aa, Mycobacterium paratuberculosis
VSGGRFGRATDGAAGRLCNPGKMTSQRPPRSTGRVPVLRDEWREPLRALRDPLAREAGRTRADRERPRQWRKQTWLGRFVSTYGWRAYALPALVVLTAVVIYQTVTGTSSPKPTASQPIQSPTAIGAVGTTIIDAPPRGLAAFDANLPAGTLPDGGPFTEAGDKTWHVVPGVTPQIGQGTAKVFKYSVEVENGIDPTMFGGDDAFAQMVDQTLANPKGWTHNPQFAFIRVDATAGAKPDFRISLVSPVTVREGCGYEFRLETSCYNPVFGANREARVFINEARCVRGAVPFEGDVGSYRQYVINHEVGHAIGYLHHEPCEQQGALAPVMMQQTFSTSNNDAAQFDPDVVKADGKTCRFNPWPYPIA

SEQ ID NO: 4744 - protein, 228 aa, Mycobacterium paratuberculosis
MSELAKMPARRAVKSADRGRPTDGAAASNRRGNRLPRDERRGQLLVVASDVFVDRGYHAAGMDEIADRAGVSKPVLYQHFTSKLELYLAVLARHVENLVSGVQQALSTTKDNRRRLHAAVQAFFDFIEHDSQGYRLIFENDYVTEPEVAAQLRVATESCIDAVYALISEDSGLDPHRARMIAVGLVGISVDCARYWLDSDRPISKADAVEGTVAFAWGGLSHVPLTRS

SEQ ID NO: 4745 - protein, 87 aa, Mycobacterium paratuberculosis
VEVKIGITDSPRELVLTSTQTPDEVEELVSAALSDGSDLLRLSDERGRRFLVHTSKIAYVEIGIADVRRVGFGVGAEVVGKHAGKGR

SEQ ID NO: 4746 - protein, 191 aa, Mycobacterium paratuberculosis
VVALGAIATAVIINSGDSASTKATVGASAPHSVTSAPATTKASVPPSASPSPSRPLPAETFTTVTSPSAAPSVAPSLTPGVAPAQTPTAAPPLAAAPTVTVDPRTVVYSVSGSKQLLDLVNVVYTDAHGVPQTEFNVSLPWSKVVVLEPGVQTESVVATSFYGRLSCSIFNAAGQRVVASANASNMATCAR

SEQ ID NO: 4747 - protein, 239 aa, Mycobacterium paratuberculosis
MTRSSCQSSEAAREADRAADSPAPRLSADHPGVNELFAVLAYGEIAAFYRLTDEAKMAPDLRGRISMASMAAAEMQHYEQLRDALESRGVDVVSAMSKYVSALENYHRLTMPSTWLEALVKTYVGDALAADLYLEIADGLPDEVADVVRAALAETGHSQFVVAEVRAAVTSSSKQRSRLALWARRLLGEAITQAQYLLAGHDELVDLVVSGAGGLGQLNAFFDRLQQTHERRMRELGLG

SEQ ID NO: 4748 - protein, 505 aa, Mycobacterium paratuberculosis
MTTPTSTTELTFAQLGVRDEIVRALDEKGIQHPFAIQELTLPLALAGDDLIGQARTGMGKTFAFGVPLLQRITAGTAPRALNGTPRALVVVPTRELCLQVTDDLTLAAKHLTADGGRPLSVVPIYGGRPYEPQIDALRAGADVVVGTPGRLLDLAQQGHLQLGGLSVLVLDEADEMLDLGFLPDIERILRQIPDDRQSMLFSATMPDPIITLARTFMNQPTHIRAEAPHSAATHDTTVQYVYRAHALDKVELVSRVLQAESRGATMIFTRTKRTAQKVADELAERGFKVGAVHGDLGQVAREKALKAFRTGDIDVLVATDVAARGIDIDDVTHVINYQIPEDEQAYVHRIGRTGRAGKAGVAVTLVDWDELARWALIDKALGLDVPEPAETYSNSPHLYEELGIPAGAGGRVGAARKPQGPRRSAERATGKPDQKSETATRRSGTRRRRTRGGQPVSGHPSGNGAASSNGEAAADAPAGSPPGNPGSSRRRRRRRKPADATAQSN

SEQ ID NO: 4749 - protein, 408 aa, Mycobacterium paratuberculosis
MVRPERRTRGDIVAAATIAVVVAATAALIWWTSDARATVSRPAAVPAPNPSPARQVPASLKQLWTAASPATTEPVVVGGVVATGAGRRIDGRDPATGQSRWSYARDTDLCGLSWLYRYAVGVYRDDRGCGQVSTLDGSTGRRGPARSGYADPRVRLSSDGMTVLSVGDTRLELWRSDMVRMLTYSETDARVKPSARGLHSGCRLISAAASSSAVSVLESCANQADLRLVLLRPGKDDDEPQQHIVAEPGIAPDSGARVLAVREATTAVYLPAPRPRVDVIDETGTTVSSTPLPRPPSPSAAVSHAGSVMTWWTGDSLMVFDVNTLALRYTIAAGDKTAPLGPGAMMAGRLLVPVTGAIGVYDPISGASERYIPVDRATSGAPPGAAVVPAVSGSRVFEQRGDTVVALG

SEQ ID NO: 4750 - protein, 266 aa, Mycobacterium paratuberculosis
VSKTRVLAVANQKGGVAKTTTVASLGAAMVDEGKRVLLVDLDPQGCLTFSLGHDPDKLPVSVHEVLLGEVEPNAALVDTAEGMTLLPANIDLAGAEAMLLMRAGREYALKRALAKLADRFDVVIVDCPPSLGVLTLNGLTAADEVIVPLQCETLAHRGVGQFLRTVADVQQITNPDLRLLGALPTLYDSRTTHTRDVLVDVADRYSLPVLAPPIPRTVRFAEASASGSSVMAGRKNKGAAAYGELAAALLKHWKSGKPLPTFTVEV

SEQ ID NO: 4751 - protein, 217 aa, Mycobacterium paratuberculosis
LACSPARRLGPAAPACRPAESLHMGLHNHRLVLLRHGETEWSKTGRHTGRTEVELTEAGRTQAERAGRALSELKLVEPLVISSPRQRSLATAELAGLNVDEVSEQLAEWDYGSYEGLTTEQIRQSVPDWLVWTHGCPGGESVAQVSGRADAAVTAALRQMESRDVVFVSHGHFCRAVMTRWVELPLAEGSRFAMITASIAVCGFEHGVRQLRALGLT

SEQ ID NO: 4752 - protein, 364 aa, Mycobacterium paratuberculosis
VNDEPTFALCGPTQTLVADGVRRSYRDVAAAQAALRSQEVSIVLGALPFDVRRPAALLTPDTVSVSDGPPDWPARKLPSVRVAAALPPPIDYRDRICRAREQLAATDNPLHKVVLARALHLVADAPLDARTILRRLIAADPGAYGYLVDLSAAGHDHAGVALVGASPELLVARTGDRVECRPFAGSAPRAADPDTDAANGAALASSAKNRHEHQLVIETIRAALEPLCDDLSIAAEPQLSRTATVWHLCTPISGRLHDRSTTAIDLALALHPTPAVGGVPTDAAVELIADLEGDRGFYAGAVGWCDARGDGRWVVSIRCAQLSADRRSALARAGGGIVAESDPDDEVAETTTKFATILNALDVR

SEQ ID NO: 4753 - protein, 110 aa, Mycobacterium paratuberculosis
VHGHVAEVDGTVAGMALWFVNFSTWDGVAGIYLEDLFVRPGFRRRGLARALLAALAAECVRRGYTRLSWAVLNWNTDAIALYDGIGARPQREWTTYRLSGPRLAELAESS

SEQ ID NO: 4754 - protein, 122 aa, Mycobacterium paratuberculosis
VAALVVAVVLVVRGIAGADQHVVNGLATAGWFVLVGAAVIGAGRALTRGKRWGRGLAVITQLLLLPVAWYLAVGSHQPGFGIPAGAVALVVLGLLFSPAAVRWAAGGQDDSASSANRGPDSR

SEQ ID NO: 4755 - protein, 321 aa, Mycobacterium paratuberculosis
MRAVLIVNPTATSTTAAGRDLLAHALKSRLQLAVEHTNHRGHGTELAQKALADGVDLVVVHGGDGTVSGVVNGLLGRPGSLPTGPVPAVAVVPGGSANVLARSLGISRDPVAATNQLIQLLDDYQRHHTWRRIGLIDCGERWAVFNTGMGVDAEVVAAVEAERDKGGKVTAWRYIRAAVPAVWGYTRREPMLTLELPGREPITGVSFAFVSNSSPWTFANERPVWTNPGCSFESGLGVFAPTTLKPIPTLRIVRQMFAKRPAFDFKQLITEDDLPCLRVTSTGGPVACQFDGDYLGVRETMTFKSVPDALAVVAPPRQKRL

SEQ ID NO: 4756 - protein, 84 aa, Mycobacterium paratuberculosis
MDWRHKAVCRDEDPELFFPVGNSGPALAQIADAKLVCNRCPVTTECLGWALNTGQDSGVWGGMSEDERRALKRRNARTKARSGV

SEQ ID NO: 4757 - protein, 499 aa, Mycobacterium paratuberculosis
MSTLGDLLAEHTMLPGNAVDHLHAVVGEWQLLADLSFADYLMWVCRDDGMLVCVAQCRPNTAPTVLQTDAVGTVVASERLTLVAETFASGAAKADDVAAQQDSWLPGTHVEASPVRYGGHVVAVLTRHQTAVAADRASGQLEIAYRECAADLVHMLAEGTFPDVGDVAMSRSTPRAGDGFIRLDVNGVVAYASPNALSAYHRMGLTTELEGHNLIEITRPLISDSFEAQEMAEHVKDLLAGGKSMRMEVDAGGATVLLRTLPLVVNGASAGAAVLIRDVTEVKRRDRALISKDATIREIHHRVKNNLQTVAALLRLQARRTTNPEGREALIESVRRVSSIALVHDALSMSVDEQVNLDEVIDRILPIMNDVASVDRPIRINRVGDLGVLDSDRATALIMVITELVQNAIEHAFDPTAAEGSVTIRAERSARWLDVVVHDDGRGLPEGFSLEASDSLGLQIVRTLVSAELDGTLGMSEASERGTDVVLRVPIGRRTRMLL

SEQ ID NO: 4758 - protein, 71 aa, Mycobacterium paratuberculosis
MAEDVRAEIVASVLEVVVNEGDQIGKGDTLVLLESMKMEIPVLAEVGGTVSKVSVSVGDVIQAGDLIAVIS

SEQ ID NO: 4759 - protein, 104 aa, Mycobacterium paratuberculosis
MSESSGQGDALSESCPNDDSHGAVGCAEVIRQVWLLLDGECGPDTREQLRRHLEACPGCFKHYGLEERIKALIATKCKGEKAPEGLRERLRLEIRRTTIIRGTQ

SEQ ID NO: 4760 - protein, 268 aa, Mycobacterium paratuberculosis
VVSTATSLLGEEQLAGFLASPGALSVLSGDTAAEGTGFIEMADSPDGPDGVTSPEVPEAHAEPAAHEEAREETDAELTARFERDAIPLLDQLYGGALRMTRNPADAEDLLQETMVKAYAGFRSFRAGTNLKAWLYRILTNTYINSYRKKQRQPAEYPTEEITDWQLASNAEHSSTGLRSAEVEALESLPDSEIKDALQALPEEFRMAVYYADVEGFPYKEIAEIMDTPIGTVMSRLHRGRRQLRGLLADVAKERGFNRGQQTHEEVSS

SEQ ID NO: 4761 - protein, 282 aa, Mycobacterium paratuberculosis
MSLNGKTMFISGASRGIGLAIAKRAAQDGANIALIAKTAEPHPKLPGTVYTAAKELEEAGGQALPIVGDVRDPESVEAAVAKTIEQFGGIDICVNNASAINLGSITEVPMKRFDLMNGIQVRGTYAVSQACIPHLKGRENPHILTLSPPVLLGKEWLEPTAYMMAKFGMTLCALGIAEEMREAGIASNTLWPRTLVATAAVQNLLGGDEAMGRARKPEVYSDAAYVILNKPAREFTGNMLLCEDVLVESGVTDLSVYNCVPGSQLGVDFWVDGVNPPGYTGP

SEQ ID NO: 4762 - protein, 315 aa, Mycobacterium paratuberculosis
VGPRDVLVRMRACGICGSDAFYISIGGVPPRQGHTPLGHEPAGEVVEVGAEVTGLAVGDHVVINPMAAPSGIIGNGGASGALADYLLIENAVRGTSLEVIPDHIPWEVAALNEPMAVARHGVNRCQPRPTDKVVVFGAGPIGLGATLAFKSLGVQHIVVIDLIPGRLDKAVRIGADAVVNSAEEDVAARLVELHGSGESMFPGKAGTDIYLDAAGAPAVVSTALAAAKKGATLGIVGVHKEPVPVDLINVMSNEITIVGSMGYPDEIFEVTGDLVRNWEKYALIVSHTIPFDRVGEALELARTPGAADKVVVTFC

SEQ ID NO: 4763 - protein, 394 aa, Mycobacterium paratuberculosis
MSDFDNITTADDVFKLAAQRTGLSEIDSDSWREGLALIVDEVNTSPVFTPFGRQRVLDDATNALGRRLQVHAYIQDHPEVLDAPVERPLIVLGMPRTGTTVISYLLDQDPARRSLLHWQCVHPIPPASTETLRTDPRCLALLDEQRKILDAVTRAKMPLPHWEDADGPTEDMFIHNQDFKGLSWDSFLPTDRYARWLFDEADMSSTYEYQKRYLQVLQSTAPGSWSLKMPSHSVHIEALLKVFPDARLIWAHRDPYKATGSLCNLWRLPQSLVMNTELLDQTEMGRLAMWQMRYHVDRPLRARERIGDERFFHMYYHEMMRDPMDVMRRIYEWADEPLTAETEARMRNWLAHHPQDRFALNAYRLDEYGLTVEALQPIFAEYLDTFDIELEGTP

SEQ ID NO: 4764 - protein, 249 aa, Mycobacterium paratuberculosis
MNTVHFDFTDARVLVTGGTSGIGNAIATAFADSGAAVTVTGTRAAATGYPDIDLGAFSYRQCHIQDPESVDALANSLSDLDILVNNAGGPYPAGDEYDPDGYVASVTQNMFGPMRLTMRCHDLLKSSRAAGGASVVNVVSMSAFRSAVFVPGYASSKMGLVALTMNLSRRWAGDGIRVNAIAPGLIDTRMTHPAMGIPEVMDVEIGFHTPLGRPGTPADCAGAALFLCTEAASYITGSTIAVDGGYLTV

SEQ ID NO: 4765 - protein, 395 aa, Mycobacterium paratuberculosis
MSPGVSNSYAVATDDGRVIVNTGLVFEGPLHRKAFADIPGPARAIIVTQGHADHWGGVNALRDGADDSDGAGDDRGTDIVMHRNYRYWRDDNALLMGYRVPKTSFAFQKFSDAMLEHFKTIEPAALDFTFPEPTVTFDQRMNLRVGGRAFELAWTPGGETTDALVVWLPEERILFTGNLFGPLFGHVPNLMTIRGDRYRDPILYIESLNTVLEFGPQRLITGHFAPIEGADRIAEEVTAMRDAMRAVHDRTAELMNSGADLYTAMREIRVPERFDIGEGYGKTSWNVRAIWEMYTGWFRHRSTTELYGVPPDSVAADLVDAAGAETLSEAARAHLDAGRPVQALHLTDLVLTAEPAHARARAVAADAHEALLAGTENFWEKAWLTKSIRELRDPE

SEQ ID NO: 4766 - protein, 267 aa, Mycobacterium paratuberculosis
LRRVAAVKGISMGLRGLADKVAVVVGGATGIGAATAARLAGEGCRVVIGDVAVDAARQTADRIAAAGGTATQVAFDLADPASVATLIDCAATTYGGVDLLFNVGADMSTIRADTDVVDIDFDVWDRVMTVSLRGYVAAMKYAIPRMLDRGGGAIVNMSSAAAFQGEPARPAYATAKAGIGALTRHVASRWGKDNIRCNAVAPGFTATETIRSVPQWPELEAAALKRIRGPRVGDPADVATLVAFLLSAEGDWINGQVINIDGGTVLR

SEQ ID NO: 4767 - protein, 207 aa, Mycobacterium paratuberculosis
MASDSRSRRRDGDERRRQLCDAAIRVLAEHGSRGLTHGQVDRYAGVPEGTTSYYYRTRAALLQGVGKRVAEIDVANLQSVIDEPLDPLSPFAHLARLTMMQASGPGLMLNRARHELLLGAARDPGLAETSQIFAGRINSMARDAIAHLQPDIRDPALLDAQTTAVTTFIAGVFTRLAAGDRNVGDAEQLAHLLEAVATAVALRAQRS

SEQ ID NO: 4768 - protein, 82 aa, Mycobacterium paratuberculosis
MDMKRCAKRFAGAGVLALAGLVTIGVGVSTAETIQTEGNYPTREACQDAGPGVKASTPGNWNNFWCVPDRNVNGNWKLVLSN

SEQ ID NO: 4769 - protein, 462 aa, Mycobacterium paratuberculosis
MSSDREAVSAAFDAIDAALDDLLDCDYVALATREKLALLNRCEKLRRRLPAVEHPLINALARDATPAELGGRLSHAIAEATLISRAEAARRVHTAADLGPRVGLTGEPLPPLLAATAAAQREGSLGLEQVAVIRKFCHQLPGWIDQATRERAEADLAREATRYRPEQLAALAGTLADCLNPDGLYRDEDRARRRSLTLGNQHADGMSELRGLLTPELRATLEAVLAKLAAPGMCNPLDENPCVEGTPSQHAIDGDARSAAQRNHDGLLAGLRALLASGNLGQHNGLPASIIVTTTLADLETAAGRGLTGGGTLLPMSDVIRLSRHARHYLAIFDQGKALALYHTKRLASPGQRIVLYAKDRGCTAPGCTIPGYYSEVHHCTDYATCHTTDINDLTFACGPHHRLLQPGAWTTHKNAKGETEWIPPPHLDRNQPRTNTFHHPEKLLRGENGGEDDDGDDDEAA

SEQ ID NO: 4770 - protein, 254 aa, Mycobacterium paratuberculosis
MCGRFAVTTDPAQLAQKIKAIDETTGAAPSDTAPNYNVAPTSTIATVVSRHSEPEDEPTRRVRLMRWGLVPPWAKAGPDGAPETKGPMLINARADKVTSSPAFRASAKSKRCLIPMDGYYEWRVNSDAAAGKKPRKTPFFMYSEDGEPLFMAGLWSVWKPAKDAPPLLSCTIITTDAPGELAQIHDRMPLVMPERDWDRWLDPDAPVDEELLTRPPDVHAIGMREVSTLVNNVRNNGPELLEPAKPEPEQARLL

SEQ ID NO: 4771 - protein, 435 aa, Mycobacterium paratuberculosis
VTTWTAPLAPQPVHATVTVPGSKSQTNRALVLAALAAAQGRGTPTLSGALRSRDTDLMIGALRTLGLRVDGTGPELTVSGHIAPGPHARVDCGLAGTVLRFVPPLAALADAVVEFDGDEQARARPIAPLLDALRGLGVRIEGTALPFRVHGSGALAGGTVAIDASASSQFVSGLLLCAASFTEGLTVQHTGAALPSAPHIAMTVAMLRQAGVDVDDSVPNRWQVRPGPVAARHWEVEPDLTNAVPFLAAAVVSGGTVRITGWPADSVQPADNILSVLGKLNAVVSQTDSSLEVRGSGSYDGFDVDLRAVGELTPSVAALAALATPGSVSRLSGIAHLRGHETDRLAALSAEINRLGGDCTETPDGLVITATPLRPGVWHAYADHRMAMAGAIVGLRVAGVRVDDIGATSKTLPDFPRLWARMLDASLPDGEEHGM

SEQ ID NO: 4772 - protein, 331 aa, Mycobacterium paratuberculosis
VRPGDYDESDVKIRSGRGSRPRTKTRPEHADARAAMVVSVDRGRWGCVLGGDPDRRVTAMRARELGRTPIVVGDDVDVVGDLSGRPDTLARIVRRGERRTVLRRTADDTDPTERVVVANADQLLIVVALADPPPRTGLVDRALIAAYAGGLVPILCLTKTDLAPPEPFAQQFADLDLTVVAAGRDDPLPAVADLLAGKVTVLLGHSGVGKSTLVNRLVPDADRAVGAVTEIGKGPHTSTQSVALPLTERLGTTGWVIDTPGIRSFGLAHIQPDDVVMAFSDLAEAIADCPRGCGHMGPPADPECALDTLTGPAARRVAAARRLLDALNQNS

SEQ ID NO: 4773 - protein, 156 aa, Mycobacterium paratuberculosis
LLQGPLADRDAWSAVGECAIEKTMAVVGTKSAMLIMREAYYGTTRFDDFARRVGITKAATSARLAELVELGLLKRRPYREPGQRSRDEYVLTQAGIDFMPVVWAMFEWGRRHLPGRHRLQLTHVGCGAEVGVEIRCAEGHLVPPDELGMRLAKNSG

SEQ ID NO: 4774 - protein, 391 aa, Mycobacterium paratuberculosis
MNRDAVIVGAVRTPIGKGKASGALHDVLPADLLAHSLRELVARTGVDPAQIDDVIAGAVTQVGDQAVNIARNALLGAGFPESVPGVTIDRQCGSSQQAINFAAQGVIAGAYDVVIAAGVESMGRVPMGSQVLPGSNPFGEAMNARYPEGLVPQGISAELIAAKWGFSRTQLDEFSAASHEKAARATKDGLFDNELIPIAGLATDEFIRPGTTVQTLAGLQPAFYSEATEARFPQINWEITAGNSSPLSDGSAAVLITSSETAARLGLRPLARIHTTAVVGSEPLYMLTGVIPATEKVLSKAGLTLADIDLFEVNEAFAPVVLAWAQDTGADLDKTNVNGGAIAIGHPLGASGARIITTLVNALEQRGGRYGLQTMCEGGGMANATIIERLS

SEQ ID NO: 4775 - protein, 174 aa, Mycobacterium paratuberculosis
VTETRYIPFHGVRVHYDSAKSYDQLRAALLADIGEQPVPLNDIATDAGDWESYRKRVESHVGPSGFMLIVLIDHGAWITKAGIERRALRVILGNPLIAITMLRHDVTAGLFAPVELLLAEEGSGSSLTYVKPSSLMVPERDPAPNPELLAAAEALDERLAALAVKVTGSVSEFA

SEQ ID NO: 4776 - protein, 380 aa, Mycobacterium paratuberculosis
MSGQCSDDIERIANRLGFGCEHAAPWVTLRNPFGLANWTLPVLELLMVAGAVLALWWAIRRLRRDRDPVNIVIWFATVIYLLIVEPPLYFPTVFRVDGTIGAVFAHNVFTVQFMYDRLPLYIVGLYPAMLTLAYEVVRSLGVFRDWGAIVGAVCVGFVHNCYYEIFDQLGPQLRWWAWNADNAINRPMLASVPLSSVLLFATVGPACVALFAQLLVTRPIERGRRLSRIALTGRTFGVAVLVPVGLVVANVPILLTGGQHPDGGLRRALYFALLAVFAVVAIPVLLRQWRNAAFTPSAPNTFVAIFGSAYLLVLGSLWVLAMPAYLNAAHGLTRDGTPTGSLAYALVCFVLAVGLTVSVTVPVGRLSGFLRRTDRREVMP

SEQ ID NO: 4777 - protein, 221 aa, Mycobacterium paratuberculosis
VYRHCPALTTFAAMRTHGWQGEPPRSDEDAVARIVAAADRCVRRRGGQTTIADVAAELGVSRKTVYRYFPSTTALLRAVATEGTRKFLEAMAERLSTIDDIAEAVVEGVVLTVTAVPDEPYLQLLLEEPSHALLRSITSETARRVGQQVLVEHTSVDWERTPMASRTLDELVEWSLRAVHSFLANPSDPPRDADQLRGYLRRWLAPAIRQWVQQAAAGTIV

SEQ ID NO: 4778 - protein, 196 aa, Mycobacterium paratuberculosis
LTIVSEMPYGASMQSPATPSARGGGIREARRRETRARLFDAALAEISQRGLAAADVSAIVADAGVARGTFYFHFPTKEHVLVEVERAEETRIVSELGGATGDLAAVLNQLVQHVLSAEKPWAQRFSGTCSDCTSARRGRSKTSWRSTRSDSSWWASSAGPRTPGRSPPTLTRPNSRRSSSPGCSRCWPPAHTTVRC

SEQ ID NO: 4779 - protein, 274 aa, Mycobacterium paratuberculosis
MTATGIEGYRAFLARRDGEADLLNRRLANREQFFTHIEANPVRSARPADRATFLRNLRRRKPEPGLDDKMLFLLATAKLNQAERFGVGLGETYGRNSDESLPPENVYLELEEHYHTRLLAYALDVFDLTFQVVPPPFVMRQFVKTGVFLPERLGFMFVGAAEMAGCILFDELRRVGSALFADEPQVAERIELLYSEILTDEIGHVGYCASRCSTAERAIMRRLYPLIGRLFARQTAEISLLVDPKALRARLDRPFDVDELTAGVDNETYLVAHP

SEQ ID NO: 4780 - protein, 427 aa, Mycobacterium paratuberculosis
MAITDVDVFAHLTDADIENLAVELDAIRQDVEDSRGERDARYIRRTIAAQRALEVTGRLLLAASSRRSAWWAGTVTLGVAKIIENMEIGHNVMHGQWDWMNDPEIHSSTWEWDMSGSSKHWRYTHNFVHHKYTNILGMDDDVGYGMLRVTRDQRWKRFNLFNLVWNTLLALLFEWGVGLQHVEIGKILKRRMDHEEARQRIDEFLAKAGRQVVKDYVAFPALTSLSPGATFLSTLKANAMANVIRNVWANAVIFCGHFPDGAEKFTKTDMIGETKGQWYLRQMLGSANFEAGPVLRFMSGNLCHQIEHHLYPDLPSNRLHEISVRVRQVCDKYDLPYTTGSFLFQYAKTWRTLAKLSLPNKYLRDDADNAPETRSERMFAELDPDFLGTDPATGRRRGLKSAIAAVRGWRRGKRASVARRTGGELAA

SEQ ID NO: 4781 - protein, 384 aa, Mycobacterium paratuberculosis
MSNTMSKTTSPITANLGDTKRPVVAGAERHPGWHALRKLAARITTPLLPDDYLHLANPLWSARELRGRVVDVRRETEDSATLVIKPGWGFNFDYQPGQYIGIGLLIDGRWRWRSYSLTSSPATSASARTVTITVKAMPEGFLSSHLVAGVEPGTVVRLAAPQGNFVLPDPAPASILFLTAGSGITPVMSMLRTLVRRNQIGDIVHLHSAPTEADVMFRGELAALANEHPGYRLQLRETRTRGRLDLSLLDREVPDWRERQTWACGPEGMLNAAERVWSAAGIGEQLHLERFAVSKAAPAGAGGMVTFARSGRSVDADAATSLMDAGEAAGVQMPFGCRMGICQSCVVGLVEGHVRDLRTGAEHEPGTRVQTCVSAASGDCVLDI

SEQ ID NO: 4782 - protein, 170 aa, Mycobacterium paratuberculosis
VATVYIPATLAMLQRLVADGSLAAVNGTAFALTPALREAYAEGDDDELAEVALREAALASLRLLAGAEHEAEHGALPPRRAVLAADVDDLTYRPDLDDAVVRLAGPVRIEDVIAAYVDNAAAEPAVAKAIEAVDAADLGDEDADLIVGDAQDHDLAWYASQELPFLLELL

SEQ ID NO: 4783 - protein, 292 aa, Mycobacterium paratuberculosis
VGLSFVAVSSAKNDGVPLKAGKKKSARAAVKIPDAVYEAELFRLQTELVKLQEWVRHSGARLVVVFEGRDAAGKGGAIKRITENLSPRVARVAALPVPTDRERGQWYYQRYIAHLPSKGEIVLFDRSWDNRAGIEKVMGFCTPQEYVLFLRQTPIFEQMLIDDGILLRKYWFSVSEAEQLRRFKARLKDPVRRWKLSPIDLESVYRWEDYSRAKDEMMVHTDTPESPWYVVESDIKKHARLNMMAHLLSTIPYHAVEAPPVKLPRRPVVTGNYQRPPRELSRYVDDYAATLI

SEQ ID NO: 4784 - protein, 423 aa, Mycobacterium paratuberculosis
MVSRLSPADASFYRLENTATPMYVGSLAILRRPRAGLSYETLLHTIEQRLPQIPRYRQKVREVPVGTARPVWIDDGDFDITYHVRRSALPSPGSDEQLHELIARLAARPLDKTRPLWEMYLVEGLSKNRLALYTKSHQALINGMTALEINHVIADRTKRPPAFPEDIWVPERDPGNTRLVLGAIGEWLVGPSAQLQAVGSAIGGLVTNYGELVDAGRRVFDFVRNVARGTAPSSPLNATVSRHRRFTVASGSLEDYRTVRARYDCDVNDVVLAVIAGALGSWLMSRGVAVSPTATVRAMAPLSVYADGDLDVSGPGQAISQVMPFLVDLPVGEPNAVVRLSQIAHATESNPTAAHLVDARTIVTLSGFAPPTLHAMGIRVATSFPSFSKRTFNLLITNAPGAQSQMYVAGTKLLETYSVPPLL

SEQ ID NO: 4785 - protein, 186 aa, Mycobacterium paratuberculosis
LNTGPVANPSDAFTVVPVVDYEPQTQDVPRALAQCRPSARAPLRRGSGHASPRACGGPPGRAAAPPSGAVMSAQLREAAVFADAALRRVLEVIDRRRPAAQLNPLLAPSLVDSVVAVGRSLTGPAPGAAVLRRMRLQPAGHGDPQTAAEVFGCYSRGNRMHAIACRVEQVPGAGGTRWMVVALHIG

SEQ ID NO: 4786 - protein, 382 aa, Mycobacterium paratuberculosis
VQISGTLLLQLGALLATLAVLGAAARRFALSPIPVYLLAGLALGKGGLLPLATGGQFITTSAPIGVVLLLLTLGCEFSLAEFSSSMRHHLPSAAVDVVLNAAPGAIAGWLLGLDGVAILCLAGVTYISSSGVVARLLEDLHRLGNRETPAVLSVLVLEDFAMAAYLPLFAVLASGGGWLHAVVGMVVAVSALVAAFAASYRWGHHVQRLVEHPDSEQLMLRVLGITLIVAAMAESLHASAAVGAFLVGLTLTGETATRTRQVLAPLRDLFAAIFFLAIGYSVDPHELIPMLPAALILAAATAATKVATGIFAARHDGVARRGQLRAGTALIARGEFSLIIIGLAGSSLPAVAALATSYVFIMAIAGPVLARYTGPRPAAPAT

SEQ ID NO: 4787 - protein, 160 aa, Mycobacterium paratuberculosis
MDVKEVLLPGVGLRYEFTDHKGDRVGIIARRSGDFDVVVYAREDPDEARPVLHLSNEEAEAVAQILGAPRIAERFTELAKEVPGLETGQVHILAGSPFVDHPLGDTRARTRTGASIVAIVRDDEVLASPGPSEMLHARDVLIVIGTEDGIAGVEKIIDKG

SEQ ID NO: 4788 - protein, 254 aa, Mycobacterium paratuberculosis
MKRYLVVGYGAAAYLLFLGAFLYLVAFLGNFWVPRTVDHGLSSPIGEAVVVNLVLLGLFGVQHSVMARPGFKAWWTRLVPATIERSTYVVLSSAVLVLLYWQWRTMPAVIWEVTAPAGRLVLWTLFWLGWVIALAATFMVSHFDLFGLRQVYLAWRGKPYSHIGFHARMLYRMVLHPLMLGFVIAFWAAPTMTAGHLLFSIAMTGYILLAVHLEEHDLVQALGDQYRDYRHRVPMLVPLGHRPRRHPTQPAGLP

SEQ ID NO: 4789 - protein, 523 aa, Mycobacterium paratuberculosis
MMLMAQAVLPTRAELLAALSVAIDLGLGQPAEHMLRAALIATRLCDRLGLSRQQRDCVYYTTLVMWIGCHADSHEYARWFGDDIAVRHDSYLVDWSGIPYLRFLASNVGRGQPLAHRLSVMATLFANARGHISRLIHSHCASAALLADRIGLGPNVQAALAYTFERYDGGGLPTGARGEDIPIQMRIAQLADMVEVHHRSYGVAGAVAMVGARRGGQFDPGIADVFLRDADAILAGPQTGDAWAAALREAPDRHRVDEQSLDAALVALGDFVDLKCPFTLGHSRAVARLAGQAARAAGLDADAVALTRRAGHVHDLGRIGVSNQIWSRPGPLSGSQFERVRLHPYLTVRILDQVPGLRRLAEVAGNHHECLDGSGYPRGLAGPALGMPDRILAAAVCYQSGREPRPYREQLSEAEAARRLRGRVRCGELDPVAAEAVLHAAGQPVGPRPNPRPDGLTPREIEVLGHVARGASNKEIAAALVISEKTARNHVERTYAKIGVSNRIGASMYALQHGLVPAAPLHS

SEQ ID NO: 4790 - protein, 260 aa, Mycobacterium paratuberculosis
MRGGGVGAHHACMTTTRTPLDAATAVLDDPALPAGDDERFVGFGVMGLPFGSGHYLALRQFPATSFSPGYRSVWHRDRDGVWTFYATTPGPQSCARYFGAATARDAVQCDIDVAWVTPWSLLVEIPGLLAWRIELRATVATRLMSALGARLPQRAWTSRAVLAVLGRAAGPLLRAGRVRLCGTVPNGQRFMLAPAQVWAVHHSRAVLDGADLGPVGPLRRQARLAGFRPPQRGVFAVGGGHFENFDPGRHHAAPRTVAIG

SEQ ID NO: 4791 - protein, 940 aa, Mycobacterium paratuberculosis
VLSKLLRLGEGRMLKRLKRVADYVNTLSDEVEKLTDAELRAKTDEFKKRHADGESLDDLLPEAFAVAREAAWRVLDQRPFDVQVMGAAALHFGNVAEMKTGEGKTLTSVLPAYLNGIGGKGVHVVTVNDYLAKRDSEWMGRVHRFLGLDVGVILAQMTPDERRVAYNADITYGTNNEFGFDYLRDNMAHSLDDLVQRGHNFAIVDEVDSILIDEARTPLIISGPADGASNWYLEFARLAPLMEKDVHYEVDLRKRTVGVHELGVEFVEDQLGIDNLYEAANSPLVSYLNNALKAKELFHRDKDYIVRDGEVLIVDEFTGRVLYGRRYNEGMHQAIEAKEHVEIKAENQTLATITLQNYFRLYDKLSGMTGTAQTEAAELHEIYKLGVVPIPTNKPMIRTDQSDLIYKTEEAKYIAVVDDVVERYQKGQPVLIGTTSVERSEYLSRQFQKRRIPHNVLNAKYHEQEAGIVAVAGRRGGVTVATHMAGRGTDIVLGGNVDFLTDQRLRERGLDPVETPDEYEAAWHEELPKVKAEAAAEAKEVIEAGGLYVLGTERHESRRIDNQLRGRSGRQGDPGESRFYLSLGDELMRRFNGAALEAMLNRLNLPDDVPIEAKMVTRAIKSAQTQVEQQNFEVRKNVLKYDEVMNQQRKVIYAERRRILEGENLKEQALEMVRDVVTAYVNGATAEGYAEDWDLDALWTALKTLYPVGIDYATLTRRDADGGFDDLTREELLEALLKDAERAYATREAELEEIAGEGAMRQLERNVLLNVIDRKWREHLYEMDYLKEGIGLRAMAQRDPLVEYQREGYDMFMAMLDGMKEESVGFLFNVTVEAVPAPQVAPVQTPEGLAELGAPAEQGGTATAARDEAPTQLRAKGIDNEAPAMTYSGPSEDGSAQVQRNGGDAKTPAGVPAGASRRERRAAARQQGRGAKPPKSVKRR

SEQ ID NO: 4792 - protein, 231 aa, Mycobacterium paratuberculosis
MSRLSVDSGQILDQSSPSTDGQGQPTATAEVVFKGRNVEIPDHYRLYVSQKLARLERFDRSIYLFDVELKHAPNRRQRKSCQRVEITARGRGPVSRAEACADSFYAAFESAVDKLENRLRRVKDRRKVHYGDKTPVSLAAATAVPPHAPLPSEPQPAADHDGVEPDTELDREPGRIVRTKEHPAIPMTVDDALYEMELVGRDFFLFQDKQTERPCVVYRRHAYDYGLIRLA

SEQ ID NO: 4793 - protein, 213 aa, Mycobacterium paratuberculosis
MLDLFLPAECGGCAAPATRWCPACAAELVVKPDEPHVVNPRVDPGVPVFALGRYANTRRRALLALKEHGRADLVAPLAGALAVAVHRLLCWGIVATPLTVVPAPTRRSAARRRGGDPVTRLARAAVARHPDIAVASVLRIRALTRDSVGLGTAERERNIAGRVVLRGRPAPLPGADVLVVDDVVTTGATARESVRVLHAAGARVAAVLAIAAA

SEQ ID NO: 4794 - protein, 184 aa, Mycobacterium paratuberculosis
VNTPPVRVLGDSAYGTGAARAALADAGHVAVIKPLPLRSPVPGGFTSDDFLIDFDARIVTCPAGHGMPIRPSGGVTFERYCRSCPLASRCTTATRGRKLTLHIHEQLLRAARVAARDPDWQAEYRQHRPMVERSMAWLTRGNRKVRYRGTAKNNHWLHHRAAALNLRRLLTMGLTRTDTTWAIA

SEQ ID NO: 4795 - protein, 198 aa, Mycobacterium paratuberculosis
LSWGFGDDCWVQGRSDDQRELLDAESVAGHLLKADSMFAFLAAHRSQLFPEEMFADLFPSQRGRPSVPAEVMASVITLQALHGFSDNETVDAVTFDLRWKAACGLPITAGAFHSTTLTYWRRRLAASDRPNRIFEAVKTVVAETGVLAGKTRRALDSTVLDDAVATQDTVTQLIAAIRRVRREVPGRCSGDRSPLQRP

SEQ ID NO: 4796 - protein, 585 aa, Mycobacterium paratuberculosis
MGRKLLGLLMLAVLLAGCAGVPSSSAPQAIGTVERPAPSNLPKPTPGMDPDVLLREFLKATADPANRHLAARQFLTQSASNAWDDAGSALLIDHVVFVETRAAERVSATMRADILGSLSDMGVFETAEGVLPDPGPIELVKTSGGWRIDRLPNGVFLDWQQFQATYKRNTLYFADPTGKTVVPDPRYVAVPDHDQLATELVSKLIAGPRPEMAHTVRNLLAPPLRLRGPVTRADGGKSGIGRGYGGARIDLEKLSTTDPHSRQLVAAQIIWTLARADIRGPYVINADGAPLDDRFRDGWTTSDVAATDPGVADGAGAGLHALVNGSLVSLDGQHTVVVPGAFGRMGDQTGAALSRNGRQVASVVTLHRGAPDMAASLWIGDLGAEAVQSADGHSLSRPTWSLDDVVWVVVDGNNVLRAIQEPASGQPARLPVDSVAVATRFPGPITDLQLSRDSTRAAMVIGGQVILASVEQTQAGQYALTYPRRLGFGLGNSVVSLSWRTGDDIVVTRTDSSHPVSYVNLDGVNSDAPPHGVQMPVTTVVANPSTAYVAGPQGVLQYSPSADGQQGWSEVPGLTVPGAAPVLPG

SEQ ID NO: 4797 - protein, 564 aa, Mycobacterium paratuberculosis
MWGSRRRTRSRWGRSGPMTRGMGAVSRAVGTAWRRSLQLRVVALTLGLSLAVILALGFVLTSQVTNRVLDVKVKAAIEQIERARTTVGGIVNGEEARSLDSSLQLARNTLTSKTDSASGAGTAGTFDAVLMVPGDGPRAATTAGPVDQVPASLRGFVKAGQASYQYATVHTDGFSGPALIVGSPASSQVANLELYLIFPLKNEQATIQLVRGTMITGGAVLLVLLAGIALLVSRQVVVPVRSASRIAERFAEGHLSERMPVRGEDDMARLAMSFNDMAESLSRQITQLEEFGNLQRRFTSDVSHELRTPLTTVRMAADLIYDHSADLDPTLARSTELMVNELDRFESLLNDLLEISRHDAGVAELSVEAVDLRSTVQSALSNVGHLAEDAGIELQVELPAEEVIAEVDTRRVERILRNLIANAIDHAEHKPVKIRMAADEDTVAVTVRDYGVGLRPGEEKLVFSRFWRADPSRVRRSGGTGLGLAISIEDARLHQGRLEAWGEPGVGSCFRLTLPLVRGHKVTTSPLPMKPIPQPSPSGGQSPSTGPQHAKDRARQREHAERSL

SEQ ID NO: 4798 - protein, 228 aa, Mycobacterium paratuberculosis
MDSMRQRILVVDDDASLAEMLTIVLRGEGFDTAVIGDGTQALTAVRELRPDLVLLDLMLPGMNGIDVCRVLRADSGVPIVMLTAKTDTVDVVLGLESGADDYIMKPFKPKELVARVRARLRRNDDEPAEMLSIADVEIDVPAHKVTRNGEQISLTPLEFDLLVALARKPRQVFTRDVLLEQVWGYRHPADTRLVNVHVQRLRAKVEKDPENPTVVLTVRGVGYKAGPP

SEQ ID NO: 4799 - protein, 210 aa, Mycobacterium paratuberculosis
VLIAIEGVDGAGKRTLAEGLRKAFEAAGQSVATLAFPRYGRSVTADIAAEALHGEHGDLASSVYAMAMLFALDRAAAVGDIEGLRRDHDVVIMDRYVASNAAYTAARLHQDADGPAVAWVHTLEYGRLKLPAPDRQVLLAVSAELAAERARSRAESDPGRARDSYERDDGLQQRTGAVYAQLAAAGWGGAWRVVDADVDPARLAADLAAG

SEQ ID NO: 4800 - protein, 496 aa, Mycobacterium paratuberculosis
MTTTENALTPDVRNGIEFKVADLSLADYGRRDIELSEQEMPGLMSLRREYHDVQPLKGARISGSLHMTVQTAVLIETLVALGAEVRWASCNIFSTQDHAAAAVVVGPHGTPEEPRGVPVFAWKGETLEEYWWAAEQALTWPPLADGTEAPANMILDDGGDATMLVLRGAQYEKAGVVPPDDEDDSAEHRVFLNLLRARFETDKTKWTKISESIKGVTEETTTGVLRLYQFAAAGDLAFPAINVNDSVTKSKFDNKYGCRHSLIDGINRGTDVLIGGKNVLVCGYGDVGKGSVESLAGQGARVTVTEIDPINALQALMEGYNVKRVEDVIGEADIVITATGNKDIITLEHMKAMKDKAILGNIGHFDNEIQIARLEKSGAIKTNIRPQVDLWTFPDTGKSIIVLSEGRLLNLGNATGHPSFVMSNSFSNQVIAQIELWTKNDEYDNEVYRLPKHLDEKVARIHVEALGGELTKLTKEQAEYIGVDVDGPYKADHYRY

SEQ ID NO: 4801 - protein, 266 aa, Mycobacterium paratuberculosis
VRIRVRRGQGLAGGRHRPGHPLGRHPGGLELPGLRRGEKRLRDGGSGAALIGLKPDAQTRYCRGCEADAVRRGVARPAARLGAGCDAGSAGDPGLVGHHAVRRGPGRRHQPSDHLQRVRLPARPGAGVRAAPSRPPGRHHPRGPGRPRRQHLRVVPGRLPQVLRRRGGRPAGDLAAHRRRQARPVAADHHRQRGHHHPRVGAAGLGADAHLGVHHRRGRRGAGPRHRAAGAELRVDAARGRPRRGRRSGPVDDAVRRAARRRQRRV

SEQ ID NO: 4802 - protein, 447 aa, Mycobacterium paratuberculosis
LALQTDTFCLDRRRRRRYCQPPTWCDSRGGFQMTTVDLQQPSDPAAWRDKKRRLWLMGLIAPTALFVMLPLVWALNRLGWHAAAQVPLWIGPILLYVLLPILDLRFGPDGQNPPDEVMERLENDKYYRYCTYVYIPFQYLSVILGAYLFTATDLSWLGFHGGLGWAGKLGLALSVGVLGGVGINTAHEMGHKKDSLERWLSKITLAQTCYGHFYIEHNRGHHVRVATPEDPASARFGETFWEFLPRSVFGSLRSALRLEAQRLRRLGKNPWNPLTYPSNDVLNAWAMSIVLWGVLIAVFGPGLIPFVVIQAVFGFSLLEAVNYLEHYGLLRRKIDSPSGKARYERCTPEHSWNSDHVVTNLFLYHLQRHSDHHANPTRRYQTLRSLDGSPNLPSGYASMISLTYFPPLWRKVMDHRVLAHYGGDITRVNVSPRRRAKLLARYPAVTA

SEQ ID NO: 4803 - protein, 505 aa, Mycobacterium paratuberculosis
MASRWRTKSVEQSIADTDEPDTRLRKDLTWWDLVVFGVAVVIGAGIFTVTASTTGDITGPAIWVSFVIAAGTCALAALCYAEFASTLPVAGSAYTFSYATFGEFLAWIIGWNLLLELAIGAAVVAKGWSSYLGTVFGFSGGTVKFGAAQLDWGALVIVGGVATLIALGTKLSSRFSAVITGIKVSVVVFVVVVGVFYIKRANYSPFIPKPEAGGQAKGIDQSVLSLLTGAHTSHYGWYGVLAGASIVFFAFIGFDIVATMAEETKHPQRDVPRGILASLGIVTLLYVAVAVVLSGMVSYTQLKTMPGRGQANLATAFTANGIHWASKIISIGALAGLTTVVMVLMLGQCRVLFAMARDGLLPRALAKTGSRGTPVRITVLVALVVAVTASVFPITKLEEMVNVGTLFAFVLVSAGVMVLRRTRPDLERGFKAPWVPVLPIASIGACVWLMLNLTALTWVRFGIWLVVGTAIYAGYGYWHSVQGRRDAGEPDRSDALAADPNSPVP

SEQ ID NO: 4804 - protein, 419 aa, Mycobacterium paratuberculosis
MPDGKANAREHALVIGGSIAGLCAARVLSESYSAVTVCERDELPAAPASRATVPQDRHLHLLMARGAIEFEKLFPGLLDDMTAAGVPRLHNRPECIHLGAAGHVLGTGQTLRDEFTAYVPSRPQLEWQLRKRVHAIGNVTVLRRSVAQPRFDPARARVTGVWLDPVAGGSAEFVAADLVVDAAGRGTRLPVWLSQWGFQRPPEEVIDIGINYATQHFHIPDGLIAQKVVVAGASHDEPLGLGMLCYEDRVWVLTTFGVADAKPPRTFPEMLTLARRLLPAHFGDALARAEPLGDPAFHAFPASRWRRYDKLDRVPAGIVALGDAVASFNPTFGQGMTMTALQAGHLRRALRCPDDRLAAALYRATARTTFPVWTMNAIGDVTFHHATTKRPAPWWWRPSGALFDQFLGAAETEPVLAEW

SEQ ID NO: 4805 - protein, 408 aa, Mycobacterium paratuberculosis
VELLRGALRTYAWGSRTAIAEFTERPVPAAHPEAELWFGAHPGDPAWLETDNGEITLLDALRADPEGQLGPGSRARFGDVLPFLVKVLAADEPLSLQAHPSAEQAAEGYLREERLGIPLNSPVRNYRDTSHKPELLVALYPFEALAGFRPASRTVELLRALAVSDLDPFIELLGDQSDADGLRALFTTWITAPQPDIDVLVPAVLDGAIAYLSSGATEFAAEAKTVLELGERYPGDAGVLAALLLNRVSLAPGEAIFVSAGNLHTYLRGFAVEVMANSDNVLRGGLTPKHVDVPELLRVLDFAPTTEDQLRPRVRREGFGRIYETPTDEFAVALLELEDEYVGHEVDATCSHDGPQILLCIQGCTTVHGKSGSLRLKRGMAAWVAADDAPIRLVAHEPTKLFRATVGL

SEQ ID NO: 4806 - protein, 366 aa, Mycobacterium paratuberculosis
VNATRAIDLEDTEGLLSADRDGLLRAASSAGAQVRAIATAVEEGALEPLRVEDRPRSVIWVAGRGTAETAGVMLSATLGGVASQPFALAGEAPPWVGPLDVLVVAGDDPGDPALVAAAATGVRRGARVVVVAPYEGPLRDSTAGRAAVLAPRLWVPDEFGLCRYLAAGLAVVHAVDPRPSVDLGLLADELDAEALRNSAGRELFTNPAKLLAARIADRQVALAGDSAATLALARHGSSVLLRVANQVTPATGLADAVVAMRAAVPRALEDPDAALFHDEQIDGPLPPRLRVLAVVLAAEQTVVAARTAGLDDVYLLAAEDVPDGPGGSAGSGVSPALGGPGRTEQQLAVLAVRLEMAAVYMRLVRG

SEQ ID NO: 4807 - protein, 471 aa, Mycobacterium paratuberculosis
MSRPAATVHRVVKAYDVRGLVGEELDQPLVADLGAAFAKVMRAEGAGQVVIGHDMRDSSPTLAAAFAAGVTGQGLDVVRIGLASTDQLYFASGLLDCPGAMFTASHNPAAYNGIKLCRAGARPVGADSGLRTIADDVIAGVEDYDGPPGSVGDRDVLADYGRFLRSLVDTSGLRPLRVAVDAGNGMAGLTTPAVLGPIESITLAPLYFELDGSFPHHEANPLDPANLVDLQAYVRETGADIGLAFDGDADRCFVVDERGNPVSPSTVTSLVAARELGREIGATIIHNVITSRAVPELVSERGGTPLRSRVGHSYIKALMADTGAIFGGEHSAHYYFRDFWGADSGMLAALYVLAALGEQDRPLSELTADYQRYESSGEINFTVADAGQCTEAVLRSFGTRIHSLDHVDGVTVDLGDGSWFNLRSSNTEPLLRLNVEGRTAEDVAAVVAQISAEIAAITAGTTTEADAGAAP

SEQ ID NO: 4808 - protein, 165 aa, Mycobacterium paratuberculosis
LRVSGASAAFAHDSLSSVNVPRRCCRPGCPHYAVATLTFVYSDSTAVVGPLATAREPHSWDLCVNHAGRITAPRGWDLVRHAGPLPTHPDEDDLVALADAVREGGSAERTLPYAGAAVPRNGFGDPHLHPGGAQATAPSSSLIAPPEQRSGRRRGHLRVLPDPSD

SEQ ID NO: 4809 - protein, 140 aa, Mycobacterium paratuberculosis
MRGPLLPPTVPGWRSRAERFDMAVLEAYEPIERDWQDRLADLDVAVDEIPRISAKDPDSVQWPPEVIADGPIPLARLIPAGVDIRGNATRARIVLFRKPIERRAKDTVELGELLHEILVAQVAIYLDVEPSVIDPTIDDD

SEQ ID NO: 4810 - protein, 121 aa, Mycobacterium paratuberculosis
MSYENLRGAMAGTPHTPIDSAPARPVRPHLTVVPDAPVAFEPEPLPAPVADQWQDRALCAQTDPEAFFPEKGGSTREAKKICLGCEVRHECLEYALEHDERFGIWGGLSERERRRLKRGII

SEQ ID NO: 4811 - protein, 88 aa, Mycobacterium paratuberculosis
LVPTVLMYRQFEQVIESRSATPESAGQPGNDTDVIRHGLTCRVKHFGAFPYHLVIEFRRFCCFAPSACRSHRSQFPTSFPTSGVQPQL

SEQ ID NO: 4812 - protein, 343 aa, Mycobacterium paratuberculosis
VLCEAQVKVTVLVGGVGGARFLLGVQQLFGLGQFRAQRHTHGRPDTAAGSHELTAIVNIGDDAWIHGLRVCPDLDTCMYTLGGGVDPERGWGHRDETWHAKEELARYGVQPDWFGLGDRDIGTHLVRTQMLNAGYPLTQITAALCDRWQPGARLLPVSDDRCETHVVITDPDDGSRRAIHFQEWWVRYRAQVPTHSFAFVGAEKAAATTETIAAIADADVILIAPSNPVVSVGAILAVPGVRGALRAAGAPIVGYSPIIGGKPLRGMADACLSVIGVESTAEAVGRHYGARRGTGILDCWLVSQDDHADIEGVAVRAVPLMMTDPAATAEMVSAGLQLAGVTP

SEQ ID NO: 4813 - protein, 449 aa, Mycobacterium paratuberculosis
VSPAGEHGTAAPIEILPVAGLPEFRPGDDLGAAVAKAAPWLRDGDVVVVTSKAVSKCEGRLVPAPADPEERDRLRRKLVDEEAVRVLARKGRTLITENRHGLVQAAAGVDGSNVGRDELALLPLDPDASAAALRARLRELLGVEVAVLVTDTMGRAWRNGQTDAAVGAAGLAVLHGYSGAVDQHGNELLVTEVAIADEIAAAADLVKGKLTAMPVAVVRGLSVTDDGSTARQLLRPGTEDLFWLGTAEAIELGRRQAQLLRRSVRRFSAEPVPAELVREAVAEALTAPAPHHTRPVRFVWLQTPAVRTRLLDAMKDKWRADLAGDGRPAESIERRVARGQILYDAPEVVIPMLVPDGAHSYPDAARTDAEHTMFTVAVGAAVQALLVGLAVRGLGSCWIGSTIFAADLVRTELGLPADWEPLGAIAIGYAAEPAGPRGPADPGDLLIRK

SEQ ID NO: 4814 - protein, 526 aa, Mycobacterium paratuberculosis
VTTFAGKAAASADKVRGGYYTPAPVARFLAHWVRRAGPRIVEPSCGDGAILRELARLSDRVHGVELIPHEAAKARRFAPVSAESLFSWLATAEDGGWDGVAGNPPYIRFGNWASPQRDPALALLRREGLRPTRLTNAWVPFVVAGTVLVRDGGRVGLVLPAELLQVGYAAQLREFLLSRFRDITLLTFERLVFDGVLQEVVLFCGVVGTGPARIRTVTLAGADALADIDVERLASAPALLHEHEKWTKYFLDPAAIELLRALKASATLTRLGALAEVDVGIVTGRNAFFTFTDEQVTALGLRRHCVPLVSRSAQLSGLIYDTDCRASDLAARQRGWLLNAPREPADPALTAHIRAGEAAGVHRGYKCSIRTPWWSTPSLWQPDLFLLRQIHAAPRLTVNAAGPTSTDTVHRVRVGPGVDPAALAAVFHNSVTFAFAEIMGRSYGGGVLELEPREAEQLPLPRPECADADLVGDVDLLLKAGELDKALDVVDRRVLIDALGVPPRAVADCRAAWACLRDRRKRRASR

SEQ ID NO: 4815 - protein, 177 aa, Mycobacterium paratuberculosis
VRDSVLALLTQWDPPDAAQDSLRHAVLAFVHARPDACRRECEPGHVTASTLVLDHTGDRVLLTLHRRLGRWVQLGGHCDDDAGIVAAALREATEESGIDGLRMAPGLAAVHVHPVTCSLGLPTRHLDLQFVAHAPAGARIAISDESEDLRWWPVDGLPAGTDHALAYLVAQATRASR

SEQ ID NO: 4816 - protein, 358 aa, Mycobacterium paratuberculosis
VGTPEVDVVILVGGKGTRLRPLTLSAPKPMLPTAGLPFLTHLLSRIAAAGIEHVILSTSYQAAVFEAEFGDGSKLGLQIEYVTEERPLGTGGGIANVAGQLRHDTVMVFNGDVLSGADLGQMLDFHAAQQADVTLHLVRVSDPRAFGCVTTEDGRVTAFLEKTQDPPTDQINAGCYVFARRVIDRIPRGREVSVEREVFPALLSDPDVKVCGYVDATYWRDMGTPEDFVRGSADLVRGIAPSPALHGHRGEQLVHDGAAVSPGAVLIGGTVVGRGAEIGPGVRLDGAVIFDGVKVEAGSVIERSIVGFGARIGPRALIRDGVIGDGADIGARCELLRGARVWPGVSIPDGGIRYSSDV

SEQ ID NO: 4817 - protein, 288 aa, Mycobacterium paratuberculosis
VVTVTYSPGPHLERFLASLSLATEREVCVLLADNGSTDGTPQAAVERYPNVRLFHTGANLGYGTAVNRAVAQLDRGGEWVIVANPDVQWGPGSIDALLDAAARWPRAGALGPLVRDPDGSVYPSARHLPSLVRGGMHAVVGPFWKNNPWSTAYRQERLEPSERPVGWLSGSCLLVRRSAFERVGGFDERYFMYMEDVDLGDRLGKAGWLSVYVPSAEVLHHKGHSTGADPASHLAAHHRSTYMFLADRYSGWMRAPLRWALRASLAVRARLMVRSALRESGRRVEGRH

SEQ ID NO: 4818 - protein, 307 aa, Mycobacterium paratuberculosis
MSGRIVIAGAGGQLGGYLSALAAGQGRDVVALTSAQWDITDPAAAEHIVRPGDVVINCAAYTDVDGAESDEAGAFAVNEAGPGHIARACARAGARLLHVSTDYVFGGESPAGAPDRPRPYEPGDPVAPQGVYARSKVAGERAVLAALPDPAQGVVVRTAWVYTGGTGKDFVAVMRRLAAGEGPVQVVDDQIGSPTYVGDLAAALLQIVDDRVPGPVLHAANEGAVSRFEQARAVFEECGADPARVRPVGTEHFPRPAPRPTYSALGSRESAAAGLRPLRPWRPALVAALTNAGSPAAADRPLPSTRD

SEQ ID NO: 4819 - protein, 490 aa, Mycobacterium paratuberculosis
MPVQRVVRVIATALTLAVVLGTGIAWSNVRSFEDGIFHMSAPSLGKGGDDGAIDILLVGLDSRTDAHGNPLSQQELETLRAGDEEATNTDTIILIRIPNNGKSATAISIPRDSYVAAPGLGKTKINGVYGQTREAKRASLVKAGDSAEDAAAQGTEAGREALIKTVADLTGVTVDHYAEIGLLGFALITDALGGVDVCLKEPVFEPLSGADFPAGPQRLSGPEALSFVRQRHELPRGDLDRVVRQQVVMASLAHRVISGQTLSSPATVKRLEAAVQRSVVISAGWDVMDFVQQMQKLAGGNVAFATIPVLDGAGWSDDGMQSVVRVDPHQVADWVGSLLHDQEQGKTEEIAYTPAKTTASVVNDTDINGLAAAVSDVLSAKGFATGTVGNNDGGHVKTSQVRAAKSDDLGAKEVSKELGGLPVVADSSLAPGAVRVVLANDYSGPGSGLSGTESIMPAKVSTAGAVSTNDKAPAPSPILTAGSDKPECIN

SEQ ID NO: 4820 - protein, 223 aa, Mycobacterium paratuberculosis
MLRADPVGPRITYYDDATGERIELSGVTLANWAAKTGNLLRDELGAGPASRVAILLPAHWQTAAVLFGVWWIGAEAVLAGPADLALCTPPRLDEADATGAGEVAVLSLDPFGRPVSDLPIGVTDYATAVRVHGDQIVPEPRPGPALDGRSVDQVLQQCRSSAAARGLTAADRVLSSASWPDPDALVDGLLAILAVGGSLVQVANADPAVQQRRIESEKVTRVL

SEQ ID NO: 4821 - protein, 93 aa, Mycobacterium paratuberculosis
MAVYGLLAKAAGTVVTGLVGVTAYEVVRKAVAKAPLHETAVKGAELGLRGTRKAEEAAESARLKLADVMAEARERIGEETPTPSIADTHDHEH

SEQ ID NO: 4822 - protein, 726 aa, Mycobacterium paratuberculosis
MNLASVRAIGDEGLTKDPALQVMSDAAGRMRVSVGWVRADSRRAVAVEEAVAKCDGVRVVHAYPRTGSVVIWYSPRRCDRSAVLAAIGEAAHVTAELIPARAPHSSEIRNADVLRMVIGGAALALLGVRRYVFARPPLLGPSGRLFATGVTVFTGYPFLRGALRSLRSGRAGTDALVSAATVASLVLRENVVALTVLWLLNIGEYLQDLTLRRTRRAISELLRGSQDTAWIRLEHNEIQVATDTLQIGDEVVVHDHVAIPVDGEVIDGEAIVDQSAITGENLPVSVVVGMPVHAGSVVVRGRLVVRARAVGNQTTIGRIITRVEEAQHDRAPIQTVGENFSRRFVPTSFIVSAITLAVTGDVRRAMTMLLIACPCAVGLATPTAISAAIGNGARRGILIKGGSHLEQAGQVDAIVFDKTGTLTVGRPVVTNIVAMHKDWEPEQVLAYAASSEIHSRHPLAEAVIRSTEERHITIPPHEECEVLVGLGMRTWADGRTLLLGSPSLLQAEKVKVSKKAKEWVDKLRRQAETPLLLAVDGTLVGLISLRDEVRPEAAGVLKKLRANGIRRIVMLTGDHPDIAAVVADELGIDEWRAEVMPEDKLAAVRDLQEEGFVVGMVGDGINDAPALAAADIGIAMGLAGTDVAVETADVALSNDDLHRLLDVRDLGSRAVDVIRENYGMSIAVNAAGLIIGAGGALSPVLAAILHNASSVAVVANSSRLIRYRLN

SEQ ID NO: 4823 - protein, 304 aa, Mycobacterium paratuberculosis
MARTDDDTWDLATSVGATATMVAAGRARATRDGLIDDPFAEPLVRAVGVDFFTRWAAGELDAADVDVPGAAWGMQRMTDMLTARTRYIDAFFAEAGAAGIRQVVILASGLDARAYRLPWPAGTTVFEIDQPRVLEFKAATIAQLGAEPTAPVRAVAVDLRHDWPSALRQAGFDVGRPAAWAAEGLLGFLPPQAQDRLLDNVTALSADGSQLVAEVFANTGASGDALNAAGEKWRRHGLDVALDDLGFPGERNDPASYLQQLGWQPVRTPLNQMLANNGLPLQSTEPGAPFAQNYYCTAVLNKAG

SEQ ID NO: 4824 - protein, 406 aa, Mycobacterium paratuberculosis
MPHETPNGKPPKPLDGFRVLDFTQNIAGPMAGQVLADLGAEVIKIEAPIGEAARHITAVLPGRPPLATLFLPHNRGKKSVLADLRDDEAKQRILRLVDTADVVLEGFRPGVMERMGLGPEELQGRNPRLVYARLSAYGGNGPEGSRPGVDLMVAAESGMTTGMPTPTGKPQIIPFQLVDAASGHVLAQAVLAALLNRERHGVADVVRVAMYDVAVSLQASQLTIHLNKPNADHKPSDSASKPKRRKGVGFATQPSDAFKAADGYLVISAYVPKHWDKLCEVIGRPDLRDDERFADQRSRALNYPELTEELEKALAAKTADEWVRLLQDAGLMACHAYTWKQVVGTPLFAENELALQVGEGADAVTVIRTPARYSSFEAASAGWATDPPPALGQHTEEYLGAPQTAS

SEQ ID NO: 4825 - protein, 656 aa, Mycobacterium paratuberculosis
VSDNGPAAQVGSWFGPYRLVRLLRQGGMGEVYEAEDTRKHRLVALKLISQQFSGNPEFSARLQREADIAGRLTEPHVVPIHDYGEIDGRFFVEMRLVDGIDLGSLLHREGPLAPPRAIAIIRQVAAALDAAHAAGVTHRDVTPGNILVTPSDFAYLADFGIARAASDPGLTQVGTAIGTYYYMAPERFTDDEVTNSVDIYSLACVLTECLTGVPPYRADTVERLVAAHLTKTAPPLSQLRPGAFPPALDRVIAKGMAKRPEDRYRTAGEFAAAAHEALTTSEQRKAATILRDGQIAALGAGAAEQRSTHWPDSFAPSPSAETVVGPSPARAGAPSSGLIRAAPTGSGRVYAPGPDFGRPAAPTDNKRKQWIIVGAVALVALVAFVVAVVGYLSTASSGPAKQAGGQSVLPFNGIDFRLSPGGVTLDGTGNVYVTSEGMYGRVVKLAAGSGATTVLPFNGLYQPQGLAVDGAGTVYVADFNNRVLSMAAGSNSQKELPFSGLNYPEGVAVDSQGGVYVADRGNSRVLKLAAGSQNQTVLPFTGLNNPDGVAVDPAGNVYVADTDNNRVVKLDAASNTQSELPFHDLSVPWGIAVDNGGTVYVTEHDKNDVMKYPPGATSGTVLPFTALNTPLAVAVDRDQSVYVADRGDDRVVKLVQ

SEQ ID NO: 4826 - protein, 378 aa, Mycobacterium paratuberculosis
LVAPAVGGGRSCVSFARSGAVLSLLAAAALTLTGCGGDSKSSSGSGAHVDCGGKKVLKDSGSTAQQNAIEQFVYAYVRACPGYTLDYNANGSGAGVTQFLNNQTDLAGSDIPLDRTTGQTDRAAARCNSPAWDLPTVFGPIAVTYHLTGVSGLKLDGPTVAKIFNGAITKWDDPALKAVNPGLNLPSTPIAVIFRSDKSGTTANFQKYLDGASNGAWGKGTSEMFTGGVGQGASGNNGTSALLQNTEGSITYNEWSFAVGKQLSMASIITSAGPDAVPITKESVEKTIAGATFQGQGNDLVLDTSSFYRPTQQGAYPIVLATYEIVCSKYPDAATGSAVKAFMQAAIGPGQDGLDQYGSIPLPGSFTAKLSSAVNAIS

SEQ ID NO: 4827 - protein, 146 aa, Mycobacterium paratuberculosis
MTTAGRAIDILLVEDDPGDELITREAFEHNKLNNRLHVAHDGEEGLNYLYRRGEFADAPRPDLILLDLNLPKYDGRQLLEKIKSDPDLAQIPVVVLTTSSAEEDILKSYKLHANAYVTKPVDLDQFMKAVRQIDEFFVQVVRLPSA

SEQ ID NO: 4828 - protein, 531 aa, Mycobacterium paratuberculosis
VTAPRPLRLTQLTVRGWLALVLWIMGTTVLVGAVLLHRTDQVSRQVADGVGPARVAAARLQAALRDQETGLRGYLIAADRQFLAPYYDGQRTEQAAADEIRRLVGGNAGNTELIADLDAVESAAADWRTNYAEPVIASVTPRAPAVVSAPTADLGKAKFDHLRALFETQNMHLAQAAASATAELHEINGWRDWVLGAMVLAILGTGLFLGLFSRAAITRPIAQLAASCRRITEGNFVETIVAPKRPKDIRDMAIDVENMRKRMVEELDMSRSAQEQLDEQAAELRRSNTELEQFAYVASHDLQEPLRKVASFCQLLERRYGDQLDERGLEYIGFAVDGAKRMQALINDLLTFSRVGRLGTTEAEVQLDATLDAGLANLAAAVEETGAEIVRPAELPRIVGDPMLLTMLWQNLIGNAIKFRHKDRRPRVVIECAPGEGTHDGEWLLSVSDNGIGIPEEFSDKVFVIFQRLHGREVYAGTGVGLALVKKIVEHHGGTVRIDTSYTDGTRFEFSLPMPGPVDETDAVALEGAQQ

SEQ ID NO: 4829 - protein, 388 aa, Mycobacterium paratuberculosis
LIPAQAAVTPAAQRQSLKPLSVLLVEDDRGDAVLVEELVTDAVTDIRVVWAQSMAHAERELESTRPDCVLLDLHLPDPSGIDALNRIAKLDATVPIVVLTGLNDEYFGASAVAAGAQDYLVKGRVEPEMLRRALLYAIERKRAELIAADLHATQLRARENALLERGLLPSPLLLDDPGVDIVARYRPSREDALLCGDFYDVVQTPDRVVHVLIGDVAGHGPHEAALGGGAADRVPSTHPGRRARRRTDAPAGAGAALRTHRHRDLRDRAQPGDLAAAARGQRHPRRPSGDAAAGRRHRGMGRTAGRAGARAARRRLAAPPAAAARGARPAVAHRRALRGVFGAGDPTARRGRPARPGPLAGRSLRPGVRRRPDRRRPATGPAARRPHR

SEQ ID NO: 4830 - protein, 389 aa, Mycobacterium paratuberculosis
MAGWAGNPDFDLFQLPEEHQELRAAIRALAEKEIAPHAADVDENSRFPQEALEALNAAGFNAVHVPEEYGGQGADSVAACIVIEEVARVDTSASLIPAVNKLGTMGLILRGSDELKKQVLPSIADGSAMASYALSEREAGSDAASMRTRARADGDDWILNGAKCWITNGGKSSWYTVMAVTDPDKGANGISSFMVHKDDEGFTVGPKEKKLGIKGSPTTELYFENCRIPGDRIIGEPGTGFKTALATLDHTRPTIGAQAVGIAQGALDAAIAYTKERKQFGRPVSDNQGVQFMLADMAMKVESARLMVYHAAARAERGESHLGFISAASKCLASDVAMEVTTDAVQLFGGYGYTQDFPVERMMRDAKITQIYEGTNQIQRVVMSRALLR

SEQ ID NO: 4831 - protein, 183 aa, Mycobacterium paratuberculosis
MGPTRTGAASMSVTEAPRVAVIMGSDSDWSVMADAAAALAEFDVPAEVRVVSAHRTPGVMFDYARDAAGRGIEVIIAGAGGAAHLPGMVASATPLPVIGVPVPLGRLDGLDSLLSIVQMPAGVPVATVSIGGARNAGLLAVRILGASDPGLRARIVEFQTQLADSVRAKDEALQRLHGKVTGQ

SEQ ID NO: 4832 - protein, 426 aa, Mycobacterium paratuberculosis
MAVPSTRPPGAASAKAAPRAVPRAVPVVAMVGGGQLARMTHQAAIALGQSLRVLATAADESAALVASDVVIGSHTDLEDLRRLAAGADVLTFDHEHVPGELLDKLVAEGVNVAPPPQALVHAQDKLVMRRRLESLGVPVPRYAEINSLDELDAFARRVGGPVVVKAVRGGYDGRGVRMARDPVHAREIAAAFLADGVPVLAEEQVSLRRELSALVARSPFGQGAAWPVVETVQRDGICVQVIAPAPGLGEDLAADAQRLALRLAGELGVVGVLAVELFETTDGALLVNELAMRPHNSGHWTMDGSRTGQFEQHLRAVLDYPLGDTDALAPVTVMANVLGARERPRMSVDERLHHLFARMPDARVHLYGKAERPGRKVGHINFLGDFPAADTAGLAALRRRAELAAHWLSHGQWTDGWDPHEQERHQ

SEQ ID NO: 4833 - protein, 221 aa, Mycobacterium paratuberculosis
VSFAEATIARLPRLLQPYLLRHHELIKFAIVGGTTFVIDSAIFYTLKLTILEPKPVTAKVIAGIVAVIASYVLNREWSFRNRGGRERHHEALLFFAFSGVGVLLSMAPLWFSSYVLQLRQPTVSLTVENVADFISAYIIGNLLQMAFRFWAFRRWVFPDQFARDPDKALESALTAGGIAEIFEDAFEDDGGNVTLLRAWRNRAGRLTQLGDSSEPRVSKTS

SEQ ID NO: 4834 - protein, 172 aa, Mycobacterium paratuberculosis
MGYPDNVLAAGEHVIVHRHPHWKRLIGPVLVLVLGTGLAAFGSGYLDSTHFEQLAKNIIHGVIWGIWLVIVGWLTLWPFFGWLTTHFVVTNRRVMFRHGVATRTGIDIPLARINSVEFRDRITERMLRTGTLIIESASQDPLEFHDIPRLREVHALLYHEVFDTLGSEESPS

SEQ ID NO: 4835 - protein, 281 aa, Mycobacterium paratuberculosis
VSSRLGPVTDRDRLRAPLDAAALRAELIGTGLGWRRLDVVEQTGSTNADLLARAAAGDDVAGAVLIAEHQTAGRGRHGRGWSATPRAQVTMSVGVSVVDVPAAGWGWLPLATGVAVVDTVAPLLQPAGVAVGLKWPNDVLAGPAGTPGKLAGILAEVSKPVVVIGLGLNVTQSADEIDGPGATSLLDLGVAAPDRTALVSGLLRELGRRIVSWQAARGADWALAADYRARSLTIGTRVRADLPGGKHVEGTASGIDDQGRLCLDSGGQTVVVAAGDVVHLR

SEQ ID NO: 4836 - protein, 512 aa, Mycobacterium paratuberculosis
VDRGVRRAGGGIRCRRRHRRLHRGARGPRGAARRGDVEFGGTTAYSGGGGVWFPCNPVLIRAGTDDTIEDALTYYHAVVGDRTPRELQETYVRGGAPLIEYLEADPHLAFVPLPWPDYYGKAPKARLDGQRHIAAKPLPVAAAPEFRTLIRGPLDTDRLGAEPPSDYYLGGRALIARFLRAIGEFPTATLRRDTALVELVRSDGRVVGAVVETGGERRAVRARRGVLLAAGGFEANPDLRRAYGVPGQARDTMGGPGSRGLALQAGIAVGADTDLLDQAWWSPGLTHPDGRSAFALWFTGGIFVNQSGDRFVNESMAYDRAGRQILAQLRDGSLRLPYWMIYDDKEGAVPPVKATNVSLVETEKYVAAGLWHTADNLPELAAKIGVPAQRLTATVLRFNGFAAAGVDEDFGRGDEAFDRAFSAGASPLVPIDTPPYHAAAFGVSDLGTKGGLRTDTAARVLDTAGRPIPGLYAAGNTMAAPSGTTYPGGGNPIGTSMLFSHLAVLDMRDRRP

SEQ ID NO: 4837 - protein, 546 aa, Mycobacterium paratuberculosis
MTSVTDHTAEPAAEHSIDIHTTAGKLAELHKRREESLHPVGEEAVEKVHAKGKLTARERILALLDEDSFVELDALARHRSKNFGLENNRPLGDGVITGYGTIDGRDVCIFSQDATVFGGSLGEVYGEKIVKVQELAIKTGRPLIGINDGAGARIQEGVVSLGLYSRIFRNNILASGVIPQISLIMGAAAGGHVYSPALTDFVVMVDQTSQMFITGPDVIKTVTGEDVTMEELGGAHTHMAKSGTLHYVASGEQDAFDWVRDLLSYLPPNNATDPPRYAEPHPAGAIEDNLTDEDLELDTLIPDSPNQPYDMHEVITRILDDDEFLEIQGGYAQNIVVGFGRIDGRPVGIVANQPTQFAGCLDINASEKAARFVRTCDCFNIPIIMLVDVPGFLPGTGQEYNGIIRRGAKLLYAYGEATVPKITVITRKAYGGAYCVMGSKDMGCDVNIAWPSAQIAVMGASGAVGFVYRKQLAEAAKKGEDVDALRLQLQQEYEDTLVNPYVAAERGYVDAVIPPSHTRGYIATALRLLERKIAHLPPKKHGNIPL

SEQ ID NO: 4838 - protein, 86 aa, Mycobacterium paratuberculosis
MSSATSDENGSAATEAAPHEPHIQILKGEPTVEEVAALVTVLGCVGGAPEPEQPEKTRWGLPVDRLRFAMSNYQRLTMQQMTHLRR

SEQ ID NO: 4839 - protein, 210 aa, Mycobacterium paratuberculosis
LTRLVLASASAGRLKVLRQAGVDPLVVVSGVDEDAVIAALGPDASPSAVVCALATAKADRVAGALQAGVAADCVVVGCDSMLFIDGGLCGKPGSADAALRQWRRIGGRSGGLYTGHCLLRLRDGDITHREVESACTTVHFASPVEADLRAYVAGGEPLAVAGGFTLDGLGGWFVDGIDGDPSNVIGVSLPLLRTLLTRVGLSVSALWAAD

SEQ ID NO: 4840 - protein, 298 aa, Mycobacterium paratuberculosis
VPLPPDPHPSLQEYAHPERLVTADWLSANLGAPGLVIVESDEDVLLYDVGHIPGAVKIDWHTDLNDPRVRDYIDGARFAELMDRKGISRDDTVVIYGDKSNWWAAYALWVFTLFGHPDVRLLNGGRDLWLAERRETTLDVPTKTSTGYPVVTRNDAPIRAFKDDVLAILGSQPLIDVRSPDEYTGKRTHMPEYPEEGVLRGGHIPTARSIPWAKAVDESGRFRSRAELEELYGFLRPDDKTVVYCRIGERSSHTWFVLTHLLGKPGVRNYDGSWTEWGNTVRTPIVAGEEPGQAPAGV

SEQ ID NO: 4841 - protein, 140 aa, Mycobacterium paratuberculosis
MSIPAPLAEVVSDFAEVQGQDKLALLLEFANELPPLPPELEEAAMEPVPECQTPLFMHVDASDRNRVRLHFSAPAESPTTRGFAAILATGLDRQPAADILAVPEDFYDDLGLAALISPLRLRGLSAMLARIKRRLRESPG

SEQ ID NO: 4842 - protein, 607 aa, Mycobacterium paratuberculosis
LPICQTGGAVASHASSRISKVLVANRGEIAVRVIRAARDAGLSSVAVYAEPDADAPHVRLADEAFALGGQTSAESYLDFGKLLDAAAKSGANAIHPGYGFLSENADFAQAVIDAGLIWIGPSPQSIRDLGDKVTARHIAARAQAPLVPGTPDPVKDADEVVAFAKEYGVPIAIKAAFGGGGKGMKVARTIEEIPELYESAVREAVAAFGRGECFVERYLDKPRHVEAQVIADQHGNVVVAGTRDCSLQRRFQKLVEEAPAPFLSDAQRKEIHESAKRICKEAHYYGAGTVEYLVGQDGLISFLEVNTRLQVEHPVTEETAGIDLVLQQFKIANGDKLDITEDPEPRGHAIEFRINGEDAGRNFLPAPGPVTRYDIPTGPGVRLDSGVEAGSVIGGQFDSMLSKLIVYGADRQQALARARRALDEFHVEGLATVIPFHRAVVRDPAFIGDDNGFAVHTRWIETEWNNTVEPFTGGEPLDDEDARPRQKAVVEVGGRRLEVSLPGDLALSNGGSADPAGVIRKKPKPRKRGGHGGATASGDAVTAPMQGTVVKVAVEEGQEVSAGDLVVVLEAMKMENPVTAHKDGVITGLAVEAGAAITQGTVLAEIK

SEQ ID NO: 4843 - protein, 144 aa, Mycobacterium paratuberculosis
MESAMSVAQSWQQSRTAQFTARWGLTGTLITVDGELDAANADQLAAYVQQSVNRSRRVILDLRGLNFIGTAGFSALHRINVICSAAQTSWAMAPSPAVARLLRLCDPDGTLPVTTPKAEPLLEPRRANDDESPGPLLQLVTKPR

SEQ ID NO: 4844 - protein, 262 aa, Mycobacterium paratuberculosis
VTARAAGGSVSRPNEYADVPDMFRELATAEPDSMEFQRQRDKIVERCLPLADHIARRFEGRGEPRDDLVQVARVGLVNAVVRFDVDAGSDFVSFAVPTIMGEVRRHFRDNSWSVKVPRRLKELHLRLGTATADLSQRLGRAPTATELAAELEMDREEVVEGLVAGSSYNTLSIDSGGGSEEEEVRAIADTLGDVDTGLDRIEDQESLRPLLEALPERERTVLVLRFFESMTQTQIAERVGISQMHVSRLLAKSLTRLRDQLQ

SEQ ID NO: 4845 - protein, 172 aa, Mycobacterium paratuberculosis
MTNRLERTVHGGLQSSSSVSRPLPGDHMKDAGLHADKRPRGHRAVELHVAARLENLAMLRTLVGAIGTFEDLDFDAVADLRLAVDEVCTRLIRSATPDATLIVVVDPQDDQLVVEASAACDTHDVVAPGSFSWHVLTSLADDVQTFHDGREPNEAGSVFGITLTARRAASSR

SEQ ID NO: 4846 - protein, 103 aa, Mycobacterium paratuberculosis
MGDTFHDPVDHLRTTRPLAGESLIDVLHWPGYLLVVAGVVGACGSLAAFATGHHHEGMTAGVTAVIAAVLGLVWLAVEHRRIRRIADRWYAEHPEVHRQWPAS

SEQ ID NO: 4847 - protein, 127 aa, Mycobacterium paratuberculosis
MQKADERSGGDRLGQEDREVHAAIRFAVLCAAGAVGFLLIAAVWVSTCPTGGVDTVACGPPQRTLLAFGGPLIALAGGIWAFVRTYRVWKARGTWWGWHGAGWFLLTVMALMVAMGVAPIAGPVLAL

SEQ ID NO: 4848 - protein, 446 aa, Mycobacterium paratuberculosis
MTAALERLARARSCTGPDRVHEVLSRSILTDGFDFVLDLDRSRGSVLYDARDGRRYLDMFTFFASSALGMNHPALARDAEFRAELAAAALNKPSNSDVYSVPMARFVETFVRVLGDPALPHLFFVDGGALAVENALKVAFDWKSRHNERRGVDPALGTRVLHLRGAFHGRSGHTLSLTNTKPVTVARFPRFDWPRIDAPHLRCGADIDALEAESLRQARAAFAAHPHDIACFIAEPIQGEGGDRHFRPEFFAAMRRLCDEHDALLIFDEVQTGCGLTGTAWAYHQFGVQPDVVAFGKKTQVCGIMAGRRVDEVADNVFAVSSRLNSTWGGNLADMVRARRILEVIEADELFEHAARQGAYLLRGLHDLAREFPGLVLDVRGRGLMCAFSLPTTADRDELIGRLWRGGVIVLPTGDDGVRFRPALTVSRGEIDAAIGAVRDALPTLG

SEQ ID NO: 4849 - protein, 150 aa, Mycobacterium paratuberculosis
MSETLDDVDRILVRELVADGRATLAELAASARLSVSAVQSRVRRLEARGVITGYSARIEPEAVGHRLSAFVAITPLDPSQPDDAPARLQHIEEIESCHSVAGEESYVLLVRVESARALEDLLQRIRTAANVRTRSTIILNTFYDNRVYVP

SEQ ID NO: 4850 - protein, 419 aa, Mycobacterium paratuberculosis
VSRPKWLPTWRLRAMFAAGLSAMYAAEVPGYATLVQVCTRVNADHVARHPDAQRWGSLRRVTAERHGAIRVGSPAELRAVADLFAAFGMAPVGYYDLRRAASPIPVVCTAFRPVDGNELSLNPFRMFTSMLATRDRRYFDRDLRARVDNFLAHRQLFDPALLARARSIAAAGGCADDAARPFVAAAVASFALSGKPIERSWYDELSRVSAVAADIAGVCSTHLNHLTPRVLDIDELYRRMTGRGIAMIDAIQGPPATGGPAVLLRQTSFRALAEPRRFRGDDGRITEGTVRVRFGEVEARGVALTPRGRRRYDAAMAADDPAAVWANYFPATDAQMAAEGLGYYCGGDPSAPIVYEDFLPASAAGIFRSNLDAETPGAAQAAPAVDDSGYDQDWLAGALGREIHDPYPLYEALAQEAPR

SEQ ID NO: 4851 - protein, 509 aa, Mycobacterium paratuberculosis
MTLPTAAELRARAADALRSLGAHVELGAPDAHGLPASTPITGEVLFTVAPTTSDQAEHTITQATQAFSEWRRTPAPVRGALVARLGELLRAHRDELAALVTLEVGKITSEAAGEVQEMIDICQFAVGLSRQLYGRTIASERPGHRLSETWHPLGVVGVITAFNFPVAVWAWNAALALVCGDTVVWKPSELTPLTALATQALIARAAADVGAPPGVSAVVLGDRELGELLVDDERVALVSATGSVRMGRAVGPRVAARFGRVLLELGGNNAAVVTPSADLDLAVRAVVFAAAGTAGQRCTTLRRLIVHRSVADEVVARVVSALRRLPIGDPFEPGTLVGPLIHETAYRDMVGALESARADGGEVIDGDRRHPFAVEHPSSYYVAPAVVRMPAQTPIVATETFAPILYVLTYDRLDDAIALNNAVPQGLSSAIFTTDLREAERFLDESDCGIANVNIGTSGAEIGGAFGGEKQTGGGRESGSDSWKAYMRQSTNTVNYSGALPLAQGVEFG

SEQ ID NO: 4852 - protein, 219 aa, Mycobacterium paratuberculosis
MATARRRLSPEDRRAELLALGAEVFGKRPYDEVRIDEIAERAGVSRALMYHYFPDKRAFFAAVVKDEADRLYENTNMDDVTGLTMYEEIRVGVLAYMAYHEQNPEAAWAAYVGLGRSDPVLLGVEDDAKNRQMEHIMSRINQLLAEVPATREPDVERHLRVILHGWLAFTFEICRQRIIDPTTDADKLADACAHALLDAIGRVPEIPEELGEAMANSRL

SEQ ID NO: 4853 - protein, 1546 aa, Mycobacterium paratuberculosis
VSTPAEPRPSRPSDPLGRFSAITREWFTSTFAAPTTAQAQAWSAIADGHNTLVIAPTGSGKTLAAFLWALDSLAGQSERAPGTRVLYVSPLKALAVDVERNLRTPLAGLTRIAERAGLPAPDISVGVRSGDTPPAVRRQLINRPPDVLITTPESLFLMLTSAARETLAGVQTVIVDEIHAIAGGKRGAHLALSLERLDALREGRPAQRIGLSATVRPPEELARFLSGTAPGARTTVVAPPSAKTVELSVQVPVPDMANLANNTIWPDVENRLVDLIEAHGSTIVFANSRRLAERLTARLNEIHAERSGVELSATANPKVAGGAPAHIMASGQTYGVEPILARAHHGSVSKEQRALVEEDLKRGLLKAVVATSSLELGIDMGAVDLVIQVEAPPSVASGLQRIGRAGHQVGEVSRGVLFPKHRTDLIGCAVTAQRMLAGQIETMRVPANPLDILAQQTVAAAALEPLDADRWFETVRRAAPFATLPRSIYEATLDLLSGKYPSTEFAELRPRLVYDRDTGTLTARPGAQRLAVTSGGAIPDRGLFTVYLASEAEKPSRVGELEEEMVYESRPGDVISLAATSWRITEITHDRVLVIPAPGQPARLPFWRGDGVGRPAELGAALGAFTGELAGLSREEFDSRCAALGFDAYAVDNLYGLFDEQRTAAGVVPTDTTLLVERFRDELGDWRVILHSPYGLGVNGPLALAVGRRLRERYGIDEKPTASDDGVVVRLPDTVSDFASDGGDTPPGAELFVFDADEIDPIVTAEVGGSALFASRFRECAARALLLPRRHPGRRSPLWQQRQRAAQLLEVARKYPDFPVVLETVRECLQDVYDVPALVALMAGIAQRRVRVLEVETQRPSPFAASLLFGYVGAFMYEGDSPLAERRAAALSLDSTLLAELLGRVELRELLDPEVVAATARALQHLAPERAARDAEAVADLLRLLGPLTEDEVVARAGGADAVEVRGWLEGLRAARRAVPVSFAGRSWWVAIEDIGRLRDGLGIAVPLGVPAAFTEEVADPLGELLGRYARTHTPFSTAEAAARFGLGLRVTADVLGRLADPSTSQGRLVRGDFVAARPSEPGGVLGAEQWCDADVLRILRRRSLAALRAQVEPVSTAAYGRFLPAWHRVGAAESSRAPGHSGLDGLMSVIEQLAGVRLPASALEPLVLAPRVRDYSPALLDELLATGEVTWSGAGSISGSDGWIALHPSESAPLTLQGPADIELGEAHRAILDVLAGGGGYFFRQLATDGVSDAELKAAVWELVWAGWITGDTFAPVRALLGGGGTRRRSAPAHRAQRPPRLSRYSVAHPQARPADPTVAGRWSLLPPPEPDSTVRAHFQAELLLGRHGVLTRGAVAAEGVAGGFATLYKVLSTFEDAGRCQRGYFIESLGGAQFAVASTVDRLRGFADGVDPQRPEYRAIVLAAADPANPYGAALPWPASSADGARPGRKAGALVVLVDGELAWFLERGGRSLLTFTDDPAAQHAAAAALAGLVSARRVAAILVERIDGVPALAPRGDGAAGNDALTALADAGFARTPRGMRLR

SEQ ID NO: 4854 - protein, 250 aa, Mycobacterium paratuberculosis
MPEGDTVWHTAAVLREHLLGETLTRCDIRVPRFATVDLTGQVVDEILSRGKHLFIRVGAASIHSHLKMEGSWRVGPRVRVDHRARIVLETGAATAVGVDLGVLQILDRDRDGEAVAHLGPDLLGEDWDPARAAANLAARPQRPIAEALLDQRVLAGIGNVYCNELCFVSGHLPTTPVSAVADPRRLVSRARDMLWLNRFRWNRCTTGDTRNGRQLWVYGRAGQPCRRCGTPIEFDDSGDRVTYWCPSCQR

SEQ ID NO: 4855 - protein, 305 aa, Mycobacterium paratuberculosis
MAYARWLWLAVLAVCVVGCGVRHVSAASARDISGTFRSGGMDRTYMLHVPAGDPVGLVLSLHGGGGTGIAQRGLTGFDAVADAHNLLVVYPDGYEKSWADGRGASPADRHHVDDVAFLVGLVTKLQNDYRVAPGHVFVTGMSNGGFMSNRLACDRADVFAAVAPVAGTLGVGVACNPSRPVSVWAAHGTADPLVPFKGGAVRGRGGLSHAVSAEAMVDKWRKADGCQGDPSMELLPDARDGTVVHRFDSTSCAASTEVVFYRIDKGGHTWPGGKQYLPAAVIGPTTHTLDGSEAIAEFFLAHARD

SEQ ID NO: 4856 - protein, 149 aa, Mycobacterium paratuberculosis
VIRQPVPPRHASIRPSPASSKQRHFCSTGVSQMTSTQIRKRARPRSLVVAGLLPLAGLLGVITTPAHATSADDAFLAALKAKGINYESPDAAVNSGHTVCHELDMGQTPEQVANNVLSSSTLDSYHAGYFVGVSIKAYCPKYAAAAAGS

SEQ ID NO: 4857 - protein, 378 aa, Mycobacterium paratuberculosis
MDFGILPPEVTSALIHAGPGAWSWIEAAGVWQQLSMELEQSASSYTAELAALSTTWQGPSALAMTRALEPYVDWLRITAQQCQEIATSVQTATAAFELTHWTVVHPSLVAANRARLAMLLATNFFGINYPAIAETEAEYHAMWVNNSAAMYRYAATSATAVRLPRFTEPPQVANPSGVSTQAAMVPATNAADSGTQTGVAGTLQAASTAFFDPNTGWFKYWSTWGNQFLAASGFPINLIGVLAQLQTASGFQSLGADVAGGLAEGTAALSAAEVRLVSAVGAAGSSLAPRAALGVGISLGNLTMPPATVGMLGSQAPVQLASAASPLATGAGQPPMLPMTPMRPGGNGTRRRNGRDYDDIEYGAELPGTVMQRPPSAG

SEQ ID NO: 4858 - protein, 379 aa, Mycobacterium paratuberculosis
VMDLFAPPEVTSTLIHTGPGAGSLIEAAAAWQRVAVELENSVSSYASTLSSLIESWDGPSAMAMLQSVQPYLLWLRETAQQSAQLANSAEAAATAFGTVRSTVVHPSVVSANRTRLAQLLATNRFGTNTAAIAETENEYQTMWANNSAALSRYQAASSQATSPLTQFNSPLAVTDPGGTANQQAAVMKASVDSSGSSVGSVLNDLNMPGGFDPNAGWFNYFSTWGNQFISSGFPINLLGVWAQLATAQGVASVGGDIGSGLSEGLGATTASLANAIKGIGAGAVAPSGAMGVGVSLGKLTAPPAVVGLLPGTQTGVQLASAASPLPAAESGFPLMPMMVPPPTTSAGTGWRKRKQQKYEDVAYGREVKGKVMPRNPSAG

SEQ ID NO: 4859 - protein, 135 aa, Mycobacterium paratuberculosis
VRDQPAGALDDPGVHRRPRGHRAVGRHRRRAQRAPGHHLGAARAQLPGVAADHGGLGAGLPALAGGARARPRCPLPRRLAAALEAEPAARRLPRRGRRRGGRRDRRPLRRGALPLRHQDRPDAALNGDPPGHGTR

SEQ ID NO: 4860 - protein, 290 aa, Mycobacterium paratuberculosis
LRPAPLPVRDGLGPARVRLRGGPVLAELTARFGAAARAKVLAAEVVTADGAVVDEATVLPAGASVYLYRELPDEVVVPFDLPVLHRDDDIVVVDKPHFLATMPRGRHVAQTALVRLRRELGLPELSPAHRLDRLTAGVLLFTARREVRGAYQTLFSRGLVDKTYLARAAVDPALVFPRVLAGRIVKHRGRMQAVCEPGPPNALTEVELLSPDGLYRLRPRTGRTHQLRLQMASLGIPIIGDPLYPNIIDVPADDFSTPLQLLAQRIEFDDPRTGARRVFVNRRTLDDPGP

SEQ ID NO: 4861 - protein, 584 aa, Mycobacterium paratuberculosis
VSDPIHALGEPGSPASALGPRQRAAAWDRLGAEQFDVVVIGGGVVGSGCALDAATRGLKVALVEARDFASGTSSRSSKMFHGGLRYLEQLEFGLVREALYERELSLTTLAPHLVKPMPFLFPLTNRLWERPYIAAGIFLYDRLGGAKSVPAQKHLTRAGALRLCPGLKRSALIGGIRYYDTIVDDARHTLTVARTAAHYGVVVRNSTQVVALLREGDRVTGVRVRDSEDGSVTEVRGHVVVNATGVWTDEIQALSKQRGRFQVRASKGVHVVVPRDRIVSDVAIILRTEKSVMFVIPWGSHWIIGTTDTDWDLDLAHPAATKADIDYILSTVNTVLAIPLTHADIDGVYAGLRPLLAGESEETSKLSREHAVAVPAPGLVAIAGGKYTTYRVMAADAIDAAAQFIPARVAPSITEKVSLLGADGYCALINQAEHVAQLRGLHPYRVRHLLDRYGSLIGDVLALAADRPDLLNPITEAPGYLRVEALYAVTAEGALHLEDILARRMRISIEYSHRGVDCAREVADVVAPVLGWTAGDVEREVANYTARVQAEILSQAQPDDVSADELRASAPEARAEILEPVPLN

SEQ ID NO: 4862 - protein, 492 aa, Mycobacterium paratuberculosis
MARLLLPPRCGGHRRRARLGVVVTRIVILGGGPAGYEAALVAASSHPDSTHVTVIDSEGIGGAAVLDDCVPSKTFIASTWLRTELRRAPRLGFEIDIDDAKISLPQIHARVKQLATEQSADITEQLLGVGVHVVAGRGELIDPTPGLARHRIKATAPDGSSSEYEADVVLIATGASPRILPSAQPDGERILTWRQLYNLDALPDHLIVVGSGVTGAEFVHAYTELGVPVTVVASRDRVLPYEDADAALVLEEAFSERGVQLVKNARAQSVTRTPDGVLVTLTDGRTVAGSHALMTIGSVPNTAGLGLERVGIELGRGGYLTVDRVSRTSVPGIYAAGDCTGLLPLASVAAMQGRIAMYHALGEGVSPIRLRTVAATVFTRPEIAAVGVPQTMIDDGSVSARTIMLPLRTNARAKMSGLRQGFVKVFCRKSTGVVIGGVVVAPIASELILPIAVAVQNRITVNELAQTLAVYPSLSGSITEAARRLMAHDDLD

SEQ ID NO: 4863 - protein, 155 aa, Mycobacterium paratuberculosis
VPLYAAYGSNMDPEQMLKRAPHSPMAGTGWLHGWRLTFGGEDIGWEGALATVVEDPGSKVFVVLYDMTPADEKNLDRWEGSEFGVHKKIRCRVDRISSDTTTDPVLAWLYVLDAWEGGLPSARYLGVMADAAEIAGAPADYVHDLRTRPARNIGP

SEQ ID NO: 4864 - protein, 392 aa, Mycobacterium paratuberculosis
MSLADAATSWLAAHNQDLIEWRRHIHRYPELGRQEYATTQFVAERLAEAGLNPKVLPGGTGLTCDLGPEHEPRIALRADMDALPMAERTGAPYASTMPNVAHACGHDAHTAILLGTALVLASVPELPVGVRLIFQAAEELMPGGAIDAIAAGAITGVSRIFALHCDPRLEVGQIAVRHGPITSAADQIEITLYSPGGHTSRPHLTADLVYGLGTLITGLPGVLSRRIEPRNGTVLVWGAVNAGVAANAIPQTGVLAGTVRTASRQTWVGLEEVIRETVSGLLAPLGIEHTLQYRRGVPPVVNEDVSTRILTHAIEALGPDALADTRQSGGGEDFSWYLEEIPGAMARLGVWPGVGPQLDLHQPTFNLDERALAIGVRVMANIVEQSALFQVF

SEQ ID NO: 4865 - protein, 400 aa, Mycobacterium paratuberculosis
VPPVGSDSPLDSVEDVVRRRGADLVELSHAIHAEPELAFAEHRSCAKAQALVAERGFEITAAAGGLDTAFRADFGSGQLTIGVCAEYDALPEIGHACGHNIIAASAVGTALALVEVADDLGLRVALVGTPAEEAGGGKALLLKAGVFDDISAAVMLHPGPADIAAARSLALSEAIVRYRGKESHAAVAPHLGVNALDAVTVAQVAVGLLRQQLAPGQLVHGIVTDGGQAVNVIPGHASLQYAMRAVESDSLRELEGRMYACFAAGAMAAGCEYEIDNPAPAYDELKPDAWLANIFREEMCRLGRQPVAPEYEAALPMGSTDMGNVTQALPGIHPVVGVESGGAMVHQRAFADAAAGPSADRAVIEGAIMLARTVVALAQTPAERDRVLAAHERRRGGAHP

SEQ ID NO: 4866 - protein, 235 aa, Mycobacterium paratuberculosis
VSGGCARIWRMNLRGWPVVGPAIGTVVAVALSVVAITCGPAPRAAADGCPDVQLIFARGTAEPPGLGAVGDALFAALQPALGNRNVDAYAVNYPASYNFLTTADGANDARDHIAEMVDRCPSTRLVLGGFSQGAAAVSMLAGVPPVGQRIGNFGSAPPLDPGLASKIAAVAVFGNPGNRFNTPLSTTGAFAGRAIDLCSDGDPVCVVGGRDRDAHHVYEDPPYPAQAAGFIAGRV

SEQ ID NO: 4867 - protein, 271 aa, Mycobacterium paratuberculosis
VAETPSNPGELARQAAAVIGERTGVAEHDVAIVLGSGWSPAVAALGTPTAVLPQAELPGFRPPTAVGHTGELVSMRIGEHRVLVLVGRIHAYEGHDLCHVVHPVRAACAAGVRAVVLTNAAGGLRPDLAVGEPVLISDHLNLTGRSPLVGPQFVDLTDAYSPRLRELARQADPTLAEGVYAGLPGPHYETPAEIRMLRTLGADLVGMSTVHETIAARAAGAEVLGVSLVTNLAAGISGEPLSHTEVLAAGAASATRMGALLALILCQLPRF

SEQ ID NO: 4868 - protein, 526 aa, Mycobacterium paratuberculosis
VTPEEWIAHDPDPRTAAELAACGAAELAARFARPLRFGTAGLRGPVRAGPDAMNVAVVSRASWALAQVLKRRGPAGARVIVGRDARHGSAVFATVAAEVLAAQGFSVLLLPGPAPTPVVAFAVRHTGAAAGVQITASHNPPTDNGYKVYDGGGIQIVSPTDHQIEAAMADAPPADEIRRTPVPPAHTDLVQRYIERAAGVRRGTGSVRVALTALHGVGGTVAVDALHRAGFGRIHTVASQFAPDPDFPTVVFPNPEEPGATDALLTLAADVDADVAIALDPDADRCAVGIPDASGWRMLSGDETGWLLGDYLLSQPQRADRPVVASTVVSSRMLSAIAARHGAVHVETLTGFKWLARADAEVPGGTLVYAYEEAIGHCVDPAAVRDKDGISAAVLVCDLVAGLIARGGSVSGRLDELARRHGVHDVAAVSRRVGTDGAAELMRRLRTSPPETLAGFGVALTDITDALIFTGGDDDTSVRLVVRPSGTEPKVKCYLEIRCAPSDDLASSRRRARALRELLVATVRSW

SEQ ID NO: 4869 - protein, 257 aa, Mycobacterium paratuberculosis
MDVCVIDHPLAAARLTVLRDERTDTAGFRAALRDLTLMLVYEASRDAPRKSVRIRTPVAAAAGTRLVNPPLLVPVLRAGLGMVDPAQAALPEAEVGFVGVARDEQTHRPVPYLAALPDKLAGRPVMVLDPMLATGGSMAHTLGLLQRRGATDITVLCVVAAPEGLAAVGETAPDARVFTAAVDKGLNKAAYIVPGLGDAGDRQFGPNLFTSSAPSRPEAPAGRGRAAAKTPGRRSARSESPSSTSPSARSRKAAPPA

SEQ ID NO: 4870 - protein, 300 aa, Mycobacterium paratuberculosis
VSRENRSRRRLIGGAYRSLRLLGAVAAVALAASPLTPRTSLAAAAIPQPSHIVIVVEENRSESGIIGNKSAPFITALAASGANMTQSFAETHPSEPNYLALFAGNTFGVTKDLCPVNAGAAPNLGSELLAAGYTFVGYAEGLPSPGSPVCSAGKYARKHVPWANFTNVPAASSLPFSAFPMGNYASLPTVSFVIPNNDNNMHDGSIAQADSWLNRQLSGYANWALANNSLLIVTFDEDDNSNVGASRNQIPTVFYGAHVRPGNYAEQINHYNVLATLEQMYGLPKTGYAAGAAPITDIWG

SEQ ID NO: 4871 - protein, 437 aa, Mycobacterium paratuberculosis
MAADLVPIRLSLSAGDRYTVWAPRWRDSGDEWEAFLGKDEDLYVFSSVADLVAFVRSDEDNDLTDHPAWTRLRTAHAHKFEPAKDKQFDLVAVEELVSEKPTEESVTALAGVLAIVSSIGSVCELAAVSKFFNGNPALGTVSGGIEHFTGKAGAKRWHAIAEIIARGWDDVLGAIDDIATTPEVDEALSAKAEDELAEERDDEETDEADEAAEAPADATEPDEEALEADEADGEPDDDADETETRAAGDTVVLGGDKDFWLQVGIDPIRIITGSGTFYTLRCYLDDQPIFLGRNGRISVFTSERALARYLADEHDHDLADLSTYDDIRTAATDGSLEVEITDDNIYVLSGLADDLADGPDAVDRDQLELAVEVLRDIGDYSEDSTVDKALEPGRPLGKLVAAVLEPGSVAKPSPPYAAAVREWEKLEQFVDGRLRRG

SEQ ID NO: 4872 - protein, 218 aa, Mycobacterium paratuberculosis
LGVVSLPGIGPLPLYGFQRPGMLLFGLVPLALLALYLVVQARRRRRLHRYTDAPVAQSPWRHLPIAVSLLSLVLLTIALATPTHDMRIPRNRAVIMLVIDMSQSMRATDVEPNRLKAAEQAASQFASQLTPGINLGLVGFAGTPYLLVPPTPQHQATIDALKKLDFADSTATGEAIFTALHAISATAVAGGDTPPPARIVLLSDGGENKPSNPSDPHD

SEQ ID NO: 4873 - protein, 335 aa, Mycobacterium paratuberculosis
MKLPLLGPVSVTGFQNPWFFLALLAVLLVIGLYVVQQFARRRRVLRFANMEVLERVAPPHPSRWRHVPTILLATSLVLLTTAMAGPTSDVRIPLNRAVVMLVIDVSESMASTDVPPNRLAAAKEAGKQFADQLTPAINLGLVEFAANATLLVPPTTNRAAVKAGIDSLQPAPKTATGEGIFTALQAIATVGSVMGGGEGPPPARIVLESDGAENVPLDPNAPQGAFTAARAAKAEGVQISTISFGTPYGTVDYEGATIPVPVDDQTLQKICEITDGQAFHADSLDSLKNVYSTLQRQIGYETVKGDASMAWMLLGAVVLAGAVLAGLLLNRRLPA

SEQ ID NO: 4874 - protein, 231 aa, Mycobacterium paratuberculosis
VSIIATATLVIALAALWSIRLAWHIPFERAAVLALAFMCAQLVLALGPVDGWLSPLLHDMTGVWNLEDLIGHLLYVYGLFSIMYLVADHCDMTPGQLRWFVRNRLELPSVVICAVMIAVFVAGDIGETCVPDVVATEHTPWLRVYWFVMIAALAYIIVSTGRILLILRQHPRSRHAATAYLVALGITGACCVVFIIGIPWLQWLLVRCEVVGYAVAASYSWRNKVAYFRGR

SEQ ID NO: 4875 - protein, 280 aa, Mycobacterium paratuberculosis
MPSLKLTVIRLIRHSRVRKHRSNCRAGKRDSLRRGYAPCHHQVSSMSTSLSSPLCSFSSRATNTTRVTTAIRALAPTNAGVNRNVNRAASLGDRVMDHRSTVLAPSSTPTQPANARPGRRLHTGADEWAPRPRPPTSAAVSRIAVLYACPIQPRRRLLHEILRFGGKTDELIGFARALSVQTATLPGMSSHSPVSAAALASRLRMIMGDRKLSRTRLSHETGISRPSLSSKLDGKVEFTYSELLTIAQAVDVPLDKLLAGDDDERPFRLSDLRPRPDRPL

SEQ ID NO: 4876 - protein, 366 aa, Mycobacterium paratuberculosis
MTAPLELEQIRKAPKALLHDHLDGGLRPSTVLDIAGQTGYDGLPATDVEELATWFRTRSHSGSLERYLEPFSHTVAVMQTPEALHRVAYECVEDLAEDSVVYAEIRFAPELHINRGMSFDEIVDAVLAGFADGEKACAAAGRPIVVRLLVTAMRHAAVSREIAELAIRWRDKGVVGFDIAGAEAGNPPTRHLEAFDYMRDHNARFTIHAGEAFGLPSIHEAIAFCGADRLGHGVRIVDDIDVLADGPDKGKVRLGRLANILRDKRIPLELCPSSNVQTGAVKSIADHPFDLLARTRFRVTVNTDNRLMSDTYMSREMHRLVQAFGYGWSDLERFTINAMKSAFIPFDERLAIIDEVIKPRYAVLIG

SEQ ID NO: 4877 - protein, 427 aa, Mycobacterium paratuberculosis
MRPGFDAPTVIRTKRDGGRLSDAAIDWVIDAYTGGLVAEEQMAALLMAILLRGMDGGETAAWTSAMLASGDRLDFSDLGVPTVDKHSTGGVGDKITLPLVPVVAACGAAVPQASGRGLGHTGGTLDKLDAIAGFSAQLPSRRVREQLREVGAAIFAAGDLAPADAKLYALRDITATVESLPLIASSVMSKKLAEGAGALVLDVKVGSGALVKTEEQCRDLAHTMVGLGAAHGVPTRALLTDMNRPLGATVGNALEVAEALEVLAGGGPADVVELTLRLAAEMLALAGVGDRDPADTLRDGTAMDRFRRLVAAQGGDLSVPLPIGRHSETVTAPRGGTMGDIDAMAVGLAAWRLGAGRSRPGERVQAGAGLRIHRHPGEPVAAGEPLFTLYTDTPERFGAALAELDGGWSVGDGAPAPRPLIIDRIVT

SEQ ID NO: 4878 - protein, 133 aa, Mycobacterium paratuberculosis
MPDIDWNALRDKAIDVSAGAYAPYSRFRVGAAGLVDDGRVVTGCNVENISYGLGLCAECAVVCALYASGGGRLVALACVDGRGSVLTPCGRCRQVLAEHGGPELLIDHPGGPRRLGELLPDAFGPDQLAAGRD

SEQ ID NO: 4879 - protein, 151 aa, Mycobacterium paratuberculosis
VRGDTGVTTQPTTADPATPVSAPARKRRPPRTLYRGDPGMWSWVLHRISGATIFFFLFVHVLDAAMLRVSPQTYNAVIHDYQMPIVGVMEYGLIAAVLFHGLNGIRVILIDFWSEGPRHQRLMFWIVGVVFLLLMVPAGVVTVIHMLGHFR

SEQ ID NO: 4880 - protein, 156 aa, Mycobacterium paratuberculosis
MSTPDLQLGPGQIAPVKQRFYDRPASLDNPRSPRRRAGIPNFEKFAWLFMRFSGVALFVLAIGHLFIMLMWDDGVYRIDFNYVAQRWASPFWQLWDLALLWLAQLHGGNGLRTIIDDYSRKDSTRFWLNSLLLLSMGFTLVLGTYVLLTFDPNISG

SEQ ID NO: 4881 - protein, 584 aa, Mycobacterium paratuberculosis
MIQQHRYDVVIVGAGGAGMRAAVEAGPRVRTAVLTKLYPTRSHTGAAQGGMCAALANVEEDNWEWHTFDTVKGGDYLADQDAVEIMCKEAIDAVLDLEKMGMPFNRTPEGRIDQRRFGGHTRDHGKAPVRRACYAADRTGHMILQTLYQNCVRHDVQFFNEFYALDLVLTQTPSGPVASGVVAYELATGDIHVFHAKAVVLATGGSGRMYKTTSNAHTLTGDGIGIVFRKGLPLEDMEFHQFHPTGLAGLGILISEAVRGEGGRLLNGEGERFMERYAPTIVDLAPRDIVARSMVLEVLEGRGAGPHKDYVYIDVRHLGEDVLESKLPDITEFARTYLGVDPVHELVPVYPTCHYVMGGIPTTVTGQVLRDNTSTVPGLYAAGECACVSVHGANRLGTNSLLDINVFGRRAGIAAANYARGHDFVDMPPDPAAMVVRWVADILSEHGNERVADIRGTLQQSMDNNAAVFRTEETLKQALTDIHACKERYSRIRIHDKGKRFNSDLLEAIELGFLLELAEVTVVGALNRKESRGGHAREDYPNRDDVNYMRHTMAYKQGTDLLSDIALDFKPVVQTRYEPKERKY

SEQ ID NO: 4882 - protein, 267 aa, Mycobacterium paratuberculosis
MSVEPDVETLEPPLPPVPDEAVMVTVKIARFNPDQPDAYAETGGWQSFRVPCLPSDRMLNLLIYIKSYLDGTLTFRRSCAHGVCGSDAMRINGVNRLACKVLMRDLLPEPKKGKPGKPLTITVEPIRGLPVEKDLVVDMEPFFDAYRAVKPYLITTGNPPTRERIQSPADRARYDDTTKCILCAACTTSCPVFWHEGSYYGPAAIVNAHRFIFDSRDEGAAERLDILNEVDGVWRCRTTFNCTDACPRGIEVTKAIQEVKRAIMFSR

SEQ ID NO: 4883 - protein, 252 aa, Mycobacterium paratuberculosis
LPASVSFCPRASRQRGSRRRASRQRDARAAARRFQAPSHIAGLPRLIGMTQKTRIEPLPPQRAGLLTRAMYRIAKRRYGQVPEPFAVAAHHRRLMVASAVHETLVDRASKTLPASVRELAVYWTARQIGCSWCVDFGSMLQRLDGLDIQRLTEIDDYATSPAFTDDERAAIAYAAAITTDPHTVTDEQVDDLRARFGDAGTFELTYQIGLENMRARVNAALGITEQGFNSGDACRIPWATGDTETSDPAANR

SEQ ID NO: 4884 - protein, 308 aa, Mycobacterium paratuberculosis
VAAGDDRRRDVRAVPGEVQPEVLMSVAYRLTGTVADAEDIVQDAWLRRHGQDGAITDLRAWLTTVVSRLGLDRLRSATHRRETYTGNWLPEPVVTGLGPHSGADPLAAVVAGEDARFAAMVVLERLSPDQRVAFVLHDGFAVPFSEVAEVLGTSEAAARQLASRARKVVSAQPPPEPDPSHDEVVGQLMAAMAAGNLEAVVALLHPDVMFTGDSNGKAPTAVQVIHGADKVVRFMLGLARRYGPGFYSAYQLGLVNGELGIYTAGLPGGDGYREMCPRIMAMTVRERKVCALWDIANPDKFTGSPLGR

SEQ ID NO: 4885 - protein, 437 aa, Mycobacterium paratuberculosis
LHFARHGPDITPPIITRGHGVTIYDDRGNSYLDGLSGLFTVQVGHGRAELAEAAARQAGTLAFFPLWGYATPPAIELAERLAGYAPGDLNRVFFTTGGTEAVETAWKLAKQYFKLTGKPGKHKVISRAVAYHGTTQGALAITGLPRYKAPFEPVTPGGFRVPNTNFYRAPEAFANDPKGFGLWAADRIAEAIEFEGPDTVAAVFVEPVQNAGGSIPPPPGYFERVREICDRYDVLLVSDEVICAFGRIGSMFACADFGYVPDMITCAKGMTSGYSPIGAMIASERLFEPFDDGDTMFPHGYTFGGHPVSAAVGLVNLDIFEREGLNDRVRTLAPTFRATLEKLYDLPIVGDVRGEGFFYGVELVKDRATKQTFTDSERRALLGRVGAALFEAGLYCRTDDRGDSVIQLAPPLISGQAEFDTIEAALRGVLSDECRRL

SEQ ID NO: 4886 - protein, 83 aa, Mycobacterium paratuberculosis
LEQLLKQVEKGTQVRGPGQDRMLTELKVHRDAAPEGDLRSALTWLCNAQSRIANSPSAAHSREVLLAAYEVKRVLATAGGTRR

SEQ ID NO: 4887 - protein, 394 aa, Mycobacterium paratuberculosis
VSGTASPLGRAEPGAEPNAAPANCPYKVNTPPAVDSSEVPTAGDPPMPLAVPAKPVGGDALGSCGIVAAPNTPPLPGDVSAEAWLVADLDSGAVIAAKDPHGRHRPASIIKVLVAMAAINTLNLNKAVPGTADDAAAEGTKVGVEEGGVFTVNQLLHGLLMHSGNDAAHALAMQLGGMQQALEKINVLAAKLGGQDTRVATPSGLDAPGMSTSAYDIGLFYRYAWQNPTFADIVATRTFDFPGHGDHPGYELENDNQLLYKYPGALGGKTGYTDDAGQTFVGAANHDGRRLVAVLLHGTRQPIAPWEQAAHLLDYGFATPQGTQVGSLIAPDPSLAPAKRDGAADRLAGNAAAAGMISSADALPVRVGVAVIGTIVVFTLIMMARSMNRRPQHS

SEQ ID NO: 4888 - protein, 450 aa, Mycobacterium paratuberculosis
VARGSRRGLLVGLTAASVGVIYGYDLSIIAGAQLFVTEDFGLSTRQQELLTTMAVIGQIGGALFAGVLANAIGRQRSVLLILSGYAVFALLAAFSVGLPMLLTARLLLGLTIGVTVVVVPVYVAESAPTAVRGALLTAYQLAIVSGLIVGYLSGYLLADTHSWRWMLGLACVPAVLLLPLVFRMPDTARWYLLKGRVDDARRALLRVEPVARVDDELAEIDRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 4889 - protein, 352 aa, Mycobacterium paratuberculosis
VGLIAAGTMVASGRVRRPGWVETSGGHIAACGTGPPPRPADREFPDGTLVPGFVDMHVHGGGGASYTEPDGIAKAAAFHLRHGTTTTMASLVTGSPAELLGGVRALAEATRDRTVAGIHLEGPWLSRARCGAHDARRMRDPDPHEIDAVLDAGGGAIRMVTLAPELPGADAAIRRFADAGVVVAVGHTNADYRQTRHAIALGATVGTHLFNAMPPLHHREPGPALALLRDPRVTVELIADGVHVHPDVVHAVIDAAGPERVALVTDALAAAGRPDGAFRLGPVHIDVVAGGRAGARDDDDRGQHRHHGPALSHRGRVRRRPRRRARGRGADDVHDAGARAGARSGGQPAGRP

SEQ ID NO: 4890 - protein, 129 aa, Mycobacterium paratuberculosis
VPSATDTGRGAPYPASDKTAPWRCAMAWLILIASGVLEAVWATALSRSEGFSRLGPSLVFFVALAFSMTGLAVAMRSLPVGTSYAVWVGVGAALTVTYAALVGDEPASPVKLVLIAGIVACVAGLKLLG

SEQ ID NO: 4891 - protein, 342 aa, Mycobacterium paratuberculosis
MSEPAEAGFLDRLRARHGWLDHLIRAYQRFDDRNGGFFAAGLTYYTIFALFPLLMVGFAVFGFVLARRPQLLSSIDDHIRSQVNGALGNQLQELMNSAIDARTSVGVIGLATAVWAGLGWISHLRQALTEMWWDTQIESPGFVRNKLSDLLAMVGTFAVIVATVGLTTVGHAAPMAALLKWLGIPQFVVFDWLFWIFSILIATLVSWLLFTWMIARLPREKVSFVDSMRAGLIAAIGFEVFKQVASIYLRTVLRSPAGAAFGPVLGLMVFAYITAYLVLFCTAWAATASTDPRDRPVAPPAPAIIAPRVHLDEGLNTRQTLTAMGLGAVAALAFDRLTRRRR

SEQ ID NO: 4892 - protein, 343 aa, Mycobacterium paratuberculosis
MSTATGSRRIFSGVQPTSDSLHLGNALGAISQWVTLQDDWGDDWDAFFCVVDLHAITIAQDPAALRRRTLVTAAQYLALGIDPARSTVFVQSHVPAHTQLAWVLGCFTGFGQASRMTQFKDKSLRQGADSTTVGLFTYPVLQAADVLAYDTGLVPVGEDQRQHLELARDVAQRFNARFPDTFVVPEMLIPKVTAKIYDLADPTSKMSKSASTDAGLINLLDDPALSAKKIRSAVTDSEREIRFDTDAKPGVSNLLSIQSAVSGVDIDKLVQGYAGRGYGDLKKDTADAVVEFVTPIKARVDELMADPAELEAVLAAGAQRAQDVAGKTVERVYDRLGFLPRRG

SEQ ID NO: 4893 - protein, 284 aa, Mycobacterium paratuberculosis
MTTRAPIHLGPKDGSGEPVVLLHGFLMSQTVWHPVAPRLADTGRYEVFAPTMAGHNGGPYAGTWLLSSSVLADHVERQLDRLGWDSAHLVGNSLGGWVAFELERRGRARSVTGIGAAGGWTRWSPVKFEVIGKFIGGMPLLLLARLLGQRILQLPLSRRLATLPLSATPSGVSDRQLSGVIEDAAHCPAYFQLLVKSLLQPGLLELAQTAVPVQLVLCEKDRVVPPSRFSRHFTDHLPPETRITRLDGVGHVPMFEAPERVTTVLTDFIDDCVARSQRQQPPAS

SEQ ID NO: 4894 - protein, 412 aa, Mycobacterium paratuberculosis
MSNPANTSKIKVKGRVVELDGDEMTRVIWKMIKENLILPYLDIDLDYYDLGIEHRDRTDDQVTIDAAYAIKKHGVGVKCATITPDEARVREFNLKRMWLSPNGTIRNILGGTIFREPIVISNVPRLVPGWTKPIVIGRHAFGDQYRSTNFKVDKPGTVAITFTPADGSEPIVHEMVSIPEDGGVVMGMYNFRESIRDFARASFKYGLNAKWPVYLSTKNTILKAYDGMFKDEFQRIYDEEFKEQFEAEGLTYEHRLIDDMVAACLKWEGGYVWACKNYDGDVQSDAIAQGYGSLGLMTSVLMTADGKTVEAEAAHGTVTRHFRQYQAGKPTSTNPIASIFAWTRGLAHRGKLDDTPEVVEFAQTLERVVVSTVESGKMTKDLAILIGPDQKWQQSEEFLNSIAENLRRELTN

SEQ ID NO: 4895 - protein, 745 aa, Mycobacterium paratuberculosis
VSAEKPTVIYTLTDEAPLLATYAFLPIVRAFAEPAGIEIKTSDISVAARILAEFPEHLTEEQRVPDNLAELGRLTKLADTNIIKLPNISASVPQLIAAVKELQGKGYKIPDFPQSPKTDEDREIRERYAKCLGSAVNPVLRQGNSDRRAPKAVKEYARKHPHHMAEWSPASRTHVATMKHGDFYHGEKSMTLDRARNVKMELETKSGKTIVLKPMVSLRTGDIIDSMFMSKKALVEFYEQQMQDAYETGVMFSLHVKATMMKVSHPIVFGHAVKVFYKEAFAKHQALFDELGVDVNNGLVDLYSKIESLPASLHDEIIRDLHACHEHRPELAMVDSAKGITNFHSPSDVIVDASMPAMIRAGGKMYGADGRQKDTKAVNPESTFSRIYQEIINFCKTHGAFDPATMGTVPNVGLMAQQAEEYGSHDKTFEIPEDGVANIVDLDTGEVLLTQNVETGDIWRMPIVRDEPIRDWVKLAVTRARNSGMTAVFWLDTERPHEVELRKKVKEYLKEHDTEGLHIQIMPQVWAMRYTLERAMRGQDTIAVTGNILRDYLTDLFPILELGTSAKMLSIVPLMSGGGMYETGAGGSAPKHVHQLVEENHLRWDSLGEFLALGACFEDIGIKTGNQRAKLLGKTLDAAIGKLLENNKSPSRKTGELDNRGSQFYLALYWAQELAAQNDDDELRRHFAALAASLGENEQRIVEELAEVQGRPVDIGGYYQPDSEKTTAVMRPSKTFNEALAASQR

SEQ ID NO: 4896 - protein, 82 aa, Mycobacterium paratuberculosis
LPMNRVNAHHVSLSAQGPVMADPRLPDSRLWWLLNLVITRGTPPRLEGCRPASRGLMLALMTDTKTILLCRPGANSPVATRR

SEQ ID NO: 4897 - protein, 456 aa, Mycobacterium paratuberculosis
VSSENTDHDTDPSAHWSFETKQVHAGQHPDSATNARALPIYQTTSYTFDDTTHAAALFGLEVPGNIYTRIGNPTTDVVEQRIAALEGGVAALFLSSGQAAETFAILNLASAGDHIVSSPRLYGGTYNLFHYSLAKLGIEVSFVEDPDDLDSWQAAVRPNTKAFFAETISNPQIDILDIPGVSGVAHANGVPLIVDNTIATPYLIQPFAHGADIVVHSATKYLGGHGSAIAGVIVDGGTFDWTQGRFPGFTTPDPSYHGVVFAELGPPAYALKARVQLLRDLGSAAAPFNAFLVAQGIETLSLRMERHVANAQRVAEFLASHDGVLSVNYAGLPGSPWHERAKKLAPKGTGAVLSFELAGGVEAGKAFVNALKLHSHVANIGDVRSLVIHPASTTHAQLSPAEQLSTGVSPGLVRLAVGIEGIDDILADLELGFAAAAKFGANADTSGADPHAVAAF

SEQ ID NO: 4898 - protein, 392 aa, Mycobacterium paratuberculosis
MTIPDVPTQTLPDEGEIGFVHIGSLTTEAGAVIDDVHIAVQRWGELSPTRDNVVVVLHALTGDSHVTGPAGPGHPTGGWWDEMVGPGAPIDTDRWCAVATNVLGGCRGSTGPSSRTRDGKPWGSRFPRISIRDQVEADIAALAALGIDEVAAVVGGSMGGARALEWIVGHPSRVRAGLLLAVGARATADQIGTQCTQIAAIKSDPNWQGGDYHDTGRTPDAGLAIARRFAHLTYRGEVELDTRFGNDAQLDEDPANSGRYAVQSYLEYQGVKLVERFDAGSYVVLTEALNSHDVGRARGGVRKALRSCPVPVVVGGITSDRLYPLRLQQELAEQLPGCAELQVVDSICGHDGFLVESEAVGEMIRKTLLLAGSQSAGPGGAGPGSRKGTTRR

SEQ ID NO: 4899 - protein, 243 aa, Mycobacterium paratuberculosis
VTRSRHDRSLSFGSAAAAYERGRPSYPPEAIDWLLPVGARQVLDLGAGTGKLTTRLVERGLDVVAVDPIPDMLEVLRSSLPETRALLGTAEEIPLEDNSVDVVLVAQAWHWVDPERAIPEVARVLRPGGRLGLVWNTRDERLGWVRELGRIIGSDGDGRTHVTLPEPFTDLAHHEVEWTNYLTPQALIDLVASRSYCITSPTEVRTRTLDQVRHLLATHPALANSTGLALPYVTRCTRATLAG

SEQ ID NO: 4900 - protein, 461 aa, Mycobacterium paratuberculosis
MGCSSREEIVKVFDALDAAVDRLGELSFDALTPRECLSLLQRCETVRRRLPVPEHPLINALARDASPAELGGRLSHAIAEATLISRAEAARRVHTAADLGPRVGLTGEPLPPLLAATAARQREGSLGLEQVAVIRKFCHQLPGWIDQATRERAEADLAREGTRYRPEQLAALAGTLADCLNPDGLYRDEDRARRRSLTLGNQHADGMSELRGWLSPELRATLEAVLAKLAAPGMCNPLDESPCVEGTPSQHAIDGDARSAAQRNHDGLLAGLRALLASGNLGQHNGLPASIIVTTTLADLETAAGRRLTGGGTLLPMSDVIRLSRHAHHYLAIFDQGKALALYHTKRLASPAQRIVLYAKDRGCTAPGCTIPGYYSEVHHCTDYATCHTTDINDLTFACGPHHRLLQPGAWTTHKNAKGETEWIPPPHLDRNQPRTNTFHHPEKLLQGEDDDGEVDGDEPD

SEQ ID NO: 4901 - protein, 203 aa, Mycobacterium paratuberculosis
VRTFIPPCRKRDSDGSEFVGRDSSAVGALQADGEAGVKALARTHQWIWVLRHQPFTIRLLAAAAGLLTVASAFAAPAGAEGNGDDFIDALNHAGIDFGEPGNAMAVGESVCPMLSQPGGNFAAVASSVAGRGMSPTMARMFTTIAIQTYCPQEMANIASGNLSGAMPQVPGMPGQLPAMAGQIPGMAGQTGQLPTMPGQLPSF

SEQ ID NO: 4902 - protein, 93 aa, Mycobacterium paratuberculosis
MTARTLMRAQWPILLVGLIFAVALALVGANFWRRGSLLLGIGVGVAALLRLVLSEERAGLLVVRGKGIDFVTTAMVGAAMVYIAWTIDPLGTG

SEQ ID NO: 4903 - protein, 281 aa, Mycobacterium paratuberculosis
VGAITLDGKATRDEIFVDLKQRVAALTAAGRTPGLGTILVGDDPGSQAYVRGKHADCAKVGITSIRRDLPADISTAALNDTIDELNANPECTGYIVQLPLPKQLDENAALERVDPDKDADGLHPTNLGRLVLNNPAPLPCTPRGIVHLLRRYDAEIAGAHVVVIGRGVTVGRPLGLLLTRRSENATVTLCHTGTRDLPALTRQADIIVAAVGVPHLLTADMVRPGAAVLDVGVSRVDGKLAGDVHPDVWEVAGHVSPNPGGVGPLTRAFLLTNVVELAERE

SEQ ID NO: 4904 - protein, 405 aa, Mycobacterium paratuberculosis
MPTPPDVFSPAKLGPITLRNRIIKSATFEARTPDALVTDDLIEYHRLPAVGGVGMTTVAYCAVSPGGRTEGNGIWMRPEAVPGFRRLTDAIHAEGAAVSAQIGHAGPVANARSNKAQALAPVRFFNPIGMRFAKKATRDDIDEVIAAHANAARLAIEAGFDAVEIHLGHNYLASSFLSPLINRRNDEFGGSLQNRAKVARGMVMAVRRAVEKEGTPIAVTAKLNMADGVRGGISTEESLTTAKWLESDGGLDAIELTAGSSLVNPMYLFRGDAPLKEFAGAFKPPLRWGMRMTGKKFLREYPYRDAYLLRDAKLFRAELKMPLILLGGITNRETMDLAMAEGFEFVAMARALLAEPDLINRIAADGAAHRVHSACTHCNQCMPTIYSRTHCVVTGAPDRHTSAAT

SEQ ID NO: 4905 - protein, 873 aa, Mycobacterium paratuberculosis
VAMSAPAPPALTVHHEGSERTFAAGHDVVVGRDLRADMRITHPLISRAHLLLRYDQGKWLAIDNGSLNGTFVNGRRVPVVEIHDGCAINIGNPDGPLLTFDVGRHQGMAGRPPRTESMGIPVAAHPPAPAAWSAQLAPPVAAPPPPAGRTPNWAAPPRRPQPAPRPGPPGQTMYGGRPPGGYPPAAPPPPPVAPAPAAPHTQMAPAASKPPEVANLATKMFQALMPSRSGAIQKPAGSQTIGRATDNDIVIQDVLASRHHAFLIQTPLGTEIRDAHSVNGTFVNGVRVGSAVLTEGDVVTIGNVDLVFTRDGLIRRTEAATRSGGLEVNSVCYTVDHGKQLLDHISLTARPGTLTAIIGGSGAGKTTLSRLIVGYTTPTSGTVTFEGHNIHTEYASMRSRIGMVPQDDVVHRQLTVNQALGYAAELRLPPDTSKEERARVVAQVLEELDMTQHAETRVDKLSGGQRKRASVALELLTQPSLLLLDEPTSGLDPALDRQVMLMLRQLADAGRVVLMVTHSVSYLDVCDQILLIAPGGKTAFCGPPDQVEPALGTRNWADIFAKVGADPDEANRRFKERNQQSSQPPTPQSPADLGEPPQTDLWRQLSTIARRQVRLVVSDRGYTIFLAVLPFLIGALSLTVKGPHPGLGPADPLGPAPTQPQYIMVLLNIGAVFMGTALTIRDLIGERAIFRREQAVGLSTTAYLLAKIAVFCVFATAQAAIATIIVRLGKGAPTAHPQFFGNSTFSLFVTVAGTCIASAMLGLLLSALAQSNEQIMPLLVVSIMSQLVFSSGMIPVYQRIGLEQLAWLTPARWGYAAGASSIDFPSLVKVKQIPTNDPIWQHSKHIFVFDMAMLALLSIGYTGFVRWHIRLKR

SEQ ID NO: 4906 - protein, 822 aa, Mycobacterium paratuberculosis
LGVMTRSAQPVLTARSDRSEGSFAAGRDVVVGSDLRADLRVAHPLIARAHVLLRFEQGRWRAVDNNTLNGVYVDGRRVPAVDIQDGQTINIGKPDGPRITFEIGQHTGAVGLLPPPPRQPKPPGQPPTRSFRRRDTQRSAVPPDAATRGVPQPGPPPRTQTGRTGGSGEFPTTWVSVPGPDADRRPAPGRAAWIGRALNNDIVIHDVLASRHHAFFTPTPTGAEIRDANSSNGTFVNGVRVGAAALSDGDVVTIGNVDLVFTGGMLVRRQEAATRAGGLEVREVNFGVDGKQLLERISLVARPGTLTALIGGSGAGKTTLSRLIAGYATPTSGSVTFEGHDIHTEYASLRTRIGMVPQDDVVHRQLTVSQALGYAAELRLPPDTSKSDRAQVVAQVLDELGLTEHADTRVDRLSGGQRKRASVALELLTGPSLLILDEPTSGLDPALDRQVMTMLRQLADAGRVVLVVTHSLTYLDVCDQVLLMAPGGKTAFLGPPGQIGPAMGTTNWAHIFAKVGADPDEANRRFLAQNRPPPPARTEAPAELGAPAQTSKRRQFFTIARRQVRLVIADRAYFLFLAVLPFVMGALSLTVPGSAGFGYADPAGESAGEAGTILTLLTMAAAFMGTALTIRDLIGERPIFRREQAVGLSSTAYLLAKIVVFCVFAVAQAAVATAIVVLGKGPPTRPAVLLGNATFELFVAVAATCVAAAMLGLLLSALARSHEQIMPLLVVSLMMQMVLCGGMVPVTHRVFLDQLSWLVPSRWGYAAQAATVDLWTVSPGPQSPRDSRFQHIATAWLFDMAMLAVLSVGYAALVRWRIRLRR

SEQ ID NO: 4907 - protein, 557 aa, Mycobacterium paratuberculosis; identical to SEQ ID NO: 1700

SEQ ID NO: 4908 - protein, 137 aa, Mycobacterium paratuberculosis
LTAWVDREFERHDFTDEDLVGLSTERVVFTECNFSGANLAESRHRASAFRNCTFRRTSLWHSTFEQCTMLGSVFEQCRLRPVTFDEVDFTLAVLGGNDLRGGAADPALWTTASLAGARVDVDQAVAFALARGLRLDG

SEQ ID NO: 4909 - protein, 195 aa, Mycobacterium paratuberculosis
VAYAHSDVQLDSGDHASTKIVIAGGFGAGKTTFVGAVSEIMPLRTEAMLTDASTGVDALEATPDKRTTTVAMDFGRITLADDLVLYLFGTPGQRRFWFMWDDLVRGAIGAVVLVDCRRLQDSFAAVDFFEHRNLPFLVAVNEFDGAPRYPVEEVREALTLPPHIPVITVDARDRRSATDALIAVSEYALASLSAN

SEQ ID NO: 4910 - protein, 124 aa, Mycobacterium paratuberculosis
MDTPETWPTSRSGNLVRPYTLTSGRTDTTVDLPVEALIQTLQAGLTHRWPPGDARGRIVRLCLDSPSVAEISARLDLPLGVARVLVGDLVLSGYLRVHKTLSERSTRDERHELIGRTLRGLRAL

SEQ ID NO: 4911 - protein, 140 aa, Mycobacterium paratuberculosis
MTAPDNSWSAAPDRSLDWLVTKFAREVPGVAHALLVSVDGLPVAASEHLPRERADQLAAVASGLASLATGAAQLFEGGQVLQSVVEMSNGYLLLMQVGDGSHLAALAAASCDIGQIGYEMAVLVERVGGVVQSTRRSSVS

SEQ ID NO: 4912 - protein, 944 aa, Mycobacterium paratuberculosis
MFSRPAEPAAAEAPGPAPLGGDAVPAKRPPAWSLSNWPVRWKVLAIVLVPLMLATVFGVLRIHGAMANAAGLRLAAARADVVPAITKYMSALDVALLAGSAGRDAEGAKKNYEARKNELQTRLGDTDVTDDVRAGVNNLLDAGQMLVNKVAEGSLGLRERVTFYAPILLTAENVINASVRVDDERIRAQAQGLSRAVGARGQMTMQKILVTRGAELPEPQLRTSMATLAGTEPSTLFGMSEVLGAGSPEAKTLQQQMVSRMAIMSDPASVLVDNPDLLRSIQTTDDIADQVIKNTTASVTKSVHAQAAERRNSAILDTALVLAAIVIALAVVLLVARALVRPLRTLRDGALKVAHTDLEEEIAHVKAGGAEPIPAPLPVYTTEEIGQVAHAVDELHTQALLLAGDEARLRLLVNDMFETMSRRSRSLVDQQLALIDRLERNEDNPERLDNLFRLDHLAARLRRNSANLLVLAGAKLARDQRDPVPLATVINAAVSEVEDYRRVEIAGLPECSLLGAAAGGAIHLFAELIDNALRYSPPTTSARVSASRGGDGGVVVRIADSGLGMNDADRRIANMRLQAGGDANPDPHPENARHLGLFVVGRIAAWHGMRVGLRGPAANESGSGTTAEVYLPPTVLAGRVVAEPSGPRHIRAVSSPSAKLASAIAAPAEEGGRHDGTQQPAARGTRNAGDASTPPVTLLPRRNPGSSGIADVAAVPAPPAEPQPRRQRRELATPWWEASPAPRPAPERAPEPAPEPQQPAPRPARAASDTSAFFAARPRTETPPEAPPKPPPKPKPKPEASIPPAASTGPADDDVIYRRMLSEMLGDPHDLVNSPDLDWQSVWDRGWTLAAAAEDKPVESHTTDHGLPVRTPGARLVPGGAHGAAAEPDDEPGLNGRSPAPRRPQHAAVTRDPEAVRASFSSHFGGVRTGRSHARESSEGPDQQ

SEQ ID NO: 4913 - protein, 201 aa, Mycobacterium paratuberculosis
MVEQSIWMQKVAADPGHSHWYIERFRAMARAGDDLAGEARFVDAKAPRGARILDAGCGPGRLGSYLAAAGHQVVGVDVDPALIEAAEHDHPGPRWLVGDLAELDLPARGITDPFDVIVSAGNVMTFLAPSTRVLVLSRLRAHLAADGRAAIGFGAYREYEFTDFLNDAADAGFAPDLLLSSWDLRPFTEDSEFLVAVLRPA

SEQ ID NO: 4914 - protein, 154 aa, Mycobacterium paratuberculosis
VFKLMFVSPRIAPNTGNAIRTAAATGCELHLVEPIGFDLSEPKLRRAGLDYHDLASVTVHASLAAAWDALTPARVVAFTSHAPASFAELRYRPGDVLMFGPEPTGLDAATLADPHVTTQVRIPMLAGRRSLNLSNAAAIAVYEAWRQHGYAGAT

SEQ ID NO: 4915 - protein, 215 aa, Mycobacterium paratuberculosis
MTLNLSVDEVLTTTRSVRKRLDFDKPVPREVLMECLELALQAPTGSNAQGWQWVFVEDADKKKTIADIYLANARAYLSLPAAEYPEGDTRGERMPKVKDSAVYLAEHMHEAPVLLIPCLEGRVENAPLGLSASFWASLFPAAWSFCLALRSRGLGTCWTTLHLINDGEKQAAELLGIPHDRYSQGGLFPIAYTKGTDFRPAKRLPAQQVTHWDSW

SEQ ID NO: 4916 - protein, 1033 aa, Mycobacterium paratuberculosis
LHAHSAFSFLDGASTPEEMVEEAARLDLRALALTDHDGLYGAVRFAEAAAELDVRTVFGAELSLGPSARTEAPDPPGPHLLVLARGPEGYRRLSRQLAAAHLAGGEKGKPRYDLDALTEAAGGHWHILTGCRKGHVRQALSDGGPDAAARALADLVDRFGAARVSIELTRHGQPLDDERNAALAALAPRFGVGVVATTGAHFAGPSRRRLAMAMGAIRARESLDSAAGWLAPLGGSHLRSGAEMARLFAWRPQAVTAAAELGEQCAFGLALIAPRLPPFDVPDGHTEDSWLRQLTMTGARDRYGSPEHAPRAYAQIEHELKVIAQLQFPGYFLVVHDIARFCRENNILCQGRGSAANSAVCYALGVTAVDPVANELLFERFLSPARDGPPDIDMDIESDQREKVIQYVYDRYGRDYAAQVANVITYRGKIAVRDMARALGYSQGQQDAWSKQISSWSGPADSPDVEGIPPQVIDLANQVRNLPRHLGIHSGGMVICDRPIADVCPVEWARMENRSVLQWDKDDCAAIGLVKFDLLGLGMLSALHYAIDLVAEHKGIEVDLARLDLSEPAVYEMLARADSVGVFQVESRAQMATLPRLKPRVFYDLVVEVALIRPGPIQGGSVHPYIRRRNGVDPVLYDHPSMEPALRKTLGVPLFQEQLMQLAVDCAGFSAAEADQLRRAMGSKRSTERMRRLRSRFYDGMRALHGAPDEVIDRTYEKLEAFANFGFPESHALSFASLVFYSSWFKLHHPAAFCAALLRAQPMGFYSPQSLVADARRHGVTVHGPDVNASLAHATLENAGTEVRLGLGAVRHIGDDLAEKLVQERKANGPFTSLLDLTARLQLSVQQTEALATAGAFGCFGMSRREALWAAGAAATQRPDRLPGVGSSSHIPALPGMSELELAAADVWATGISPDSYPTQFLRDDLDAMGVVPAARLGSVPDGDRVLIAGAVTHRQRPGTAQGVTFLNLEDETGMVNVLCTPGVWARHRKLANTAPALLVRGQVQNASGAITVVAERLGRITLAVGSRSRDFR

SEQ ID NO: 4917 - protein, 424 aa, Mycobacterium paratuberculosis
MAQTLDTAFLKAHDPDQHASLAIGAVAIVDGTVPDPAQLEHLVAERILPIARCTQLLRAHPLNREWVDCPDFDLARHLRRVAIAGTGDEAELSQVIGQALRRPLHPGRPPWECWVIEGLRGNRWAMLMKTHHGLLDGNPAARLITRLCDDADADMFANNAAAQPVSPSTGWLDALSRVSSLTGGLLGALRLAGRAEAVAPVRRYATVRVPIADVDRVCRKFGVSANDVALAAVTEGFRTVLLDRGEQPRADSLRTLVPLPVRSAVLSHLPVEHDDPVRRLQTVHARCNPAAGTQPAGIVESAIGLLPNMVRGNLIQLLSRLPQRGGAQLRRRTGFRHHRRAGRRVRRHAAGRRRRAGHGAAGGPRRRFRAAVRRPAAPPRGPPAAGPGAARAPVGARARASLTGSGRDRAAVRRFSSWANRGRW

SEQ ID NO: 4918 - protein, 391 aa, Mycobacterium paratuberculosis
MGESGPVVIDPRRHDAVLFGVGDALGSALASQLGQIGVGTAAFAADGPAAAADRLRVRPGRCVVVAGDPAAVEAARTAGFALVIGLAPVGRDGDGLRGAGADAVVAELEQITVRTGDRRMSQLPDASQALTGGADGLAGRHPAVFFDFDGTLSDIVDDPDAARPVAGATAALTRLAARCPVAVLSGRDLADVTKRVGVLGIWYAGSHGFELTAPDGSHHQNDDAAAAIPVLAQAAGRLRDELGAIPGVVVEHKRFGVAVHYRNAARDRVGEVAAAVRAAGRHDALRVTTGREVIELRPDLDWDKGKTLHWVIEHLRRSGSGALTPVYLGDDITDEDAFDAVRGGPVQGVPILVRHNDDGDRATAALFALDSPARAAEFTERLADQLERGEG

SEQ ID NO: 4919 - protein, 288 aa, Mycobacterium paratuberculosis
MAIDPSAVGAVTEPLLFEWTDRDTLLYALGVGAGVDDLAFTTENSHGIDQQVLPTYAVICCPAFGAAGLVGKFNWAMLLHGSQSIRLHAPLPPAGKLSVVSEVADIQDKGEGKNAILVLRGRGTEPDSGQLIAETLTTLVIRGEGGFGGMPGQRPIAPEFPDREPDARIALPTREDQALIYRLSGDRNPLHSDPWFARELAGFPKPILHGLCTYGVSGRALVAELGGGVAANITSIASRFTSPVFPGETLTTLIWRTEPGKAVFRTEASNPDGSNTRVVLDDGAVEYA

SEQ ID NO: 4920 - protein, 410 aa, Mycobacterium paratuberculosis
LIWTMTVTEVVVAQPVWAGVDAGKADHYCMVINDDAQRLLSQRVANDEAALLELIAAVTTLADGGEVTWAIDLNAGGAALLIALLIAAGQRLLYIPGRTVHHAAGSYRGEGKTDAKDAAIIADQARMRHDLQPLRAGDDIAVELRILTSRRSDLVADRTRAINRMRAQLLEYFPALERAFDYNKSRAALILLTGYQTPDALRSAGGARVAAFLRKRKARNADTVAATALQAANAQHSIVPGQQLAATVVARLAKEVMALDTEIGDTDAMIEERFRRHRHAEIILSMPGFGVILGAEFLAATGGDMAAFASADRLAGVAGLAPVPRDSGRISGNLKRPRRYDRRLLRACYLSALVSIRTDPSSRTYYDRKRTEGKRHTQAVLALARRRLNVLWAMLRDHAVYHPATTTAAA

SEQ ID NO: 4921 - protein, 237 aa, Mycobacterium paratuberculosis
MPKRSMIRKVSVALAVLTATVTVAACGGSPQARSITVTFVRHAQSEANASGTIDTEVPGPGLSPEGKGQAEQVAHQLGRKDYDSVYASTMTRAQQTAAPLAAELGKQVEVLPGIQEINAGWYNGKSESMAKSTYLVAPANWLKGDVSDSIPGSISGKEFNDQFTAAVNKIYNSGHRNPVVFSHANSIMVWTLMNTRNAKDSLMNTHPLPNTGRVVINGNPITGWTLVDWDGIRDFRS

SEQ ID NO: 4922 - protein, 675 aa, Mycobacterium paratuberculosis
MRYVVTGGTGFIGRRVVTRLLQTRPEAQVWVLVRRQSLGRFERLSARGDTPWGDRVKPLVGELPALELSDETLAELGHVDHLVHCAAIYDITAGEAEQRAANVDGTRAVIELAQRLGATLHHVSSIAVAGDFPGEYTEDDFDVGQQLPTPYHQTKFEAELLVRSAPGLRHRIYRPAVVVGDSRTGEMDKVDRPYYFFGVLAKLAVLPRFTPMLLPDTGRTNLVPVDYVADALVALMHADGLDGQTFHLTAPKTVGLRGIYRGVAKAAGLPPLRGSLPGAVAAPVLKVRGRARVVRDMAATQLGIPAQVFDLVDLAPTFVSEKTRNALAGTGIEVPEFAGYAPRLWRYWAEHLDPDRARRDDPRGPLYGRHVIVTGASSGIGRASAIAIAQRGATVFALARNGAALDALVDEIRANGGAAHAFTCDVTDSASVEHTVKDILGRFDHVDYLVNNAGRSIRRSVVNSTDRLHDYERVMAVNYFGAVRMVLALLPHWRERRFGHVVNVSSAGVQARNPKYSSYLPTKAALDAFADVVGSEVLSDHITFTNIHMPLVRTPMIVPSHRLNPVRAISPERAAAMVVRGLVEKPARIDTPLGTLAEAGNYFAPRTSRRVLHQLYLGYPDSAAARGVATEPRPAERTERTAPRKPRRPVRAVTRGLRTPRPVRRLVRLVPGVHW

SEQ ID NO: 4923 - protein, 151 aa, Mycobacterium paratuberculosis
MVGSAGRTDIDPVGAAAELVAATGAAVLPALSVTRSLGVGREEWTRFARDPLLHKVIRLLSRIAAALDEVGEWNVQVHPFRIRSAPQECGAGGQPTPDGRRLLTATLAEPGTLLVSDDRRTLHQVSPIRPLEGDGPARRDVLVITFASGRP

SEQ ID NO: 4924 - protein, 343 aa, Mycobacterium paratuberculosis
VTPVFVDVDTGVDDALALMYLFASPDADVVGIASTGGNVAVEQVCENNLGLLQLCGLTGIPVSKGSGQTLTGPMRLPSKVHGPRGLGYAELPPSDHRVTDHDSATAWVCAAHAHPGELIGVATGPLTNLALALRAEPALPTLLRRLVIMGGSYDHRGNTTAVAEWNISVDPEAAAEVLAGWGGADVGRERLPILCGLDLTRKVAMTPGHLTRLATAADSSTRPLSADDEPGTRSAAANPLIRVIEDAMRFYLEAYHDLGHGYQAHMHDPLAAAVALDPTLVATRPATVEIELTGTLTRAMTVTDWSGRREPNALIGIDVDSAAFFDRFIERVGPFARRVGGGR

SEQ ID NO: 4925 - protein, 419 aa, Mycobacterium paratuberculosis
MTELVTGETLPNVVVTGIAMTTALATDAETTWKLLLDSQSGIRKLEDSFVEEFDLPVRIGGHLLEDFDDGLTRAERHRMGYLQMMSTVLGRRVWENAGSPEVDSNRLMVSIGTGLGSSEEMVFSYDDMRARGMKGVSPLAVSKYMPDGAAVAVGLERHAKAGVITPVSACASGSEGIAQAWRNIVFGEADIAICGGVETKIEAVAIAAFAQMRIVMSTKNDDPVGACRPFDRDRTGFVFGEAGALMVIETEEHAKARGANILARIMGASITSDGYHMVAPDPNGERAGHAMSRAIQLAGLTPGDIDHVNAHATGTSVGDVAESKAINNALGPHGGNAAVYAPKAALGHSVGAVGAVESILTVLALRDQVVPPTLNLENLDPEIDLDVVAGKPRPGNYQYAINNSFGFGGHNVAIAFGRY

SEQ ID NO: 4926 - protein, 392 aa, Mycobacterium paratuberculosis
MAFAEYQNELYDQSLHGNQPQYPIRFEELEAKASAAMTPKVLGYVAGGAGDEHTQRANCEAFKRWGLYPRMGIAPEQRDMSVELFGTRFPSPIFMAPIGVIGVCDPDGHGDLACVRASIRTGVPFFVGTLSADPMEDLADELGDTPAFFQLYTPPDRKMAASLVHRAEAASFSGIAVTLDTWVTGWRPRDLSGGNYPQVPSGCLANYTSDPVFRAGLSRGEDPTEAAVRKLPIFGGPFRWEDLEWLRSRTSLPLMAKGICHPDDVRRAKDIGVDAVYCSNHGGRQANGGLPCLDCLPGVVEAADGLPVLFDSGVRSGADIVKALALGATAVGIGRPYAYGLALGGVDGIVHVLRSLLAEADLIMAVDGYPSLKDLTPDALRRVEHVAPQRYS

SEQ ID NO: 4927 - protein, 527 aa, Mycobacterium paratuberculosis
VVTPSGSRVLAIWCMDWPAVAAAAAAELPATAPVAVTLANRVIACSSAARAAGVRRGLRRREAAARCPQLHVSTADADRDARFFEAVIAAVDDLVPRAEVLRPGLLVLPVRGAARYFGSEEAAAERLVDAVAVSSVAGAECQVGIADRLSTAVLAARAGRIVEPGGDAKFLSVLSVRQLATEPSLSGPGREELTDLLWRMGIRTIGQFAALARGDVASRFGADGVAAHRLARGEPERPPSGREPPAELEAVLDCDPPIDRVDAAAFAGRSLAGTLHQALMAAGVGCTRLAIHAATGSGEERHRVWRCAEPLTEDATADRVRWQLDGWLSNRTARDRPTAPVTLLRLRAVEVVSAEALQLPLWGGLGEEDRLRARRALVRVQGLLGPEAVQVPVRSGGRGPAERITLIPLGDEPVPQADPDLPWPGRLPEPSPAVLLDDPVELLDAQGNPIRVSSRGLFSADPARLVVHGRGERLCWWGGPWPVDERWWDDRGQGGGRTARAQVLLESERALLLCYRQRRWYLEGSYE

SEQ ID NO: 4928 - protein, 300 aa, Mycobacterium paratuberculosis
VHDGAASTGFLPARPGIATRGKKSTIRPTGTECIRLPLTFLDGCRRVGVYSPVNRTCIRNLRATSGDRRLVMTAAFASSRHEETRAERLESLRRRMAEMSGRMSGAASGAAAPADLLGAESLLAMPRWLAESVWVPRGSVAVLSGARSLLLSMVAAVTAAGGNAAIVGQPDIGLLAAAEMGADLSRLAVIPDPGTDPVEVAAVLVDGMDLVVLGLGGRRVPPTRARAVVARARSKGCTLLVTGGDWQGAPTRLAARVCGYEVTPAQWGKPAPGFGRISGVRLQVSGMCAGRRVAAQARAG

SEQ ID NO: 4929 - protein, 525 aa, Mycobacterium paratuberculosis
VAESPPTEVPEPPARPVLVVDFGAQYAQLIARRVREARVFSEVIPHTATIEEIKARQPRALVLSGGPSSVYEPGAPQLDPAVFDLGVPVFGICYGFQAMAQALGGTVAHTGTSEYGRTELKVLGGELHSGLPGVQPVWMSHGDAVTAAPDGFEVVASSPGAVVAAFENRARRLAGVQYHPEVMHTPHGQQVLSRFLHDFAGLGADWTAANIAGVLVEQVRAQIGDGHAICGLSGGVDSAVAAALVQRAIGDRLTCVFVDHGLLRAGERAQVQRDFVAATGANLVTVDAADTFLQALAGVTNPEGKRKIIGRQFIRAFEGAVRDVLGDKPVEFLVQGTLYPDVVESGGGSGTANIKSHHNVGGLPGDLKFTLVEPLRLLFKDEVRAVGRELGLPEEIVARQPFPGPGLGIRIVGEVTATRLDTLRRADSIAREELTAAGLDSLIWQCPVVLLGEVRSVGVQGDNRTYGHPIVLRPVTSEDAMTADWTRVPYEVLERISTRITNEVPEVNRVVLDITSKPPGTIEWE

SEQ ID NO: 4930 - protein, 531 aa, Mycobacterium paratuberculosis
VTTVPAMTAPIWMASPPEVHSALLSSGPGPASMFAAAAAWSALGAEYASAAEELSGLLASAQAGAWQGPSAASYVAAHGPYLAWLTRASAHSAAAAAQHETAGTAYTAALAAMPTLPELAANHAVHGALVATNFFGINTIPIAVNEADYARMWVQAAGTMATYQAVSTAAVAAVPQPDPAPSILKSTAAHDHDDHEHGDDHDHDHGFDSPLNQFVAQILRLFGIDWDPVEGTLNGLPYEAYTSPADPLWWVVRALELFSDFQQFGALLQENPAAAFQFITELVLLDWPTHLAQLASWLPTQPQLLLVPALVAAAPFGALAGFAGVAGQPPLPAPVAEPATPSAAAPTGLPATAGATPIAASAAASGPAPAPTPAPTAATVSSPAPPAPPAPGAAPFAPPYAVPPPGAGFGSKARASVDTRAKSKSPQPDSNAVGAGAAVREAAHARRRQRSRRRGDEFMDMNVGVDPDWDEPATTASPRGAGNLGFAGTAPRETVAAAGLTQLAGDEFGGGAGMPLLPGSWAPPDPRDSGV

SEQ ID NO: 4931 - protein, 262 aa, Mycobacterium paratuberculosis
MVEWIPPDPNHRKRVPVLGLPEKVHACLFDLDGVLTDTASVHTKAWKAMFDAYLADRAKRTGETFVPFDPAADYRKYVDGKKREDGVRSFLQSRGIHLPDGSPDDAEDAETIYGLGNRKNDMFQKVLKQDGVKVFDGSRRYLEAASAAGLGIAVVSSSANTRNVLEVTGLDRYVQQRVDGITLREEHLAGKPAPDSFLRGAQLLDVPAGAAAVFEDALSGVAAGRAGNFGFVVGVDRVGQAEDLRRNGADVVVSDLAELLAS

SEQ ID NO: 4932 - protein, 791 aa, Mycobacterium paratuberculosis
MIADESFPVDPWHVRETQLNLNLLAQSESLFTLSNGHIGLRGNLDEGEPYGLPGTYLNSFYEIRPLPYAEAGYGYPEAGQTLVDVTNGKIIRLLVEDEPFDVRYGELLSHERTLDLRAGTLTRSAYWRSPAGKEVKVVSTRLVSLAQRGVAAIEYVVQAVGDFVRVTVQSELVTNEDQPQTSGDPRVSAILENPLEEVDHENTDTGALLMHRTRSSALMMAAGMDHEVEVPGRVEVSTDSRADLARTTVICGLRAGQKLRIVKYLAYGWSSMRSRPALRDQVAAALHSARYTGWPGLLESQRKYLDNFWDCADVEVEGDPESQQAVRFGLFHLLQASARAERRAIAAKGLTGTGYDGHAFWDTEGYVLPVLTYTAPHTVADALRWRASTLDLAKERAAELGLEGAAFPWRTIRGQECSAYWPAGTAAWHINADIAMAFERYRIVTGDDDLEAECGLPVLVETARLWLSLGHHDRHGVWHLDGVTGPDEYTAVVRDNVFTNLMAAHNLRVAAEACNRHPDGAKALGVTTEETAAWRDAADAVKIPYDSGLGVHQQCEGFTTFAEWDFEHNTTYPLLLHEAYVRLYPAQVIKQADLVLAMHWQSHAFTPEQKARNVDYYEPRMVRDSSLSACTQAVMCAEVGHLELAHDYAYEAALIDLRDLHHNTRDGLHMASLAGAWTALVSGFGGLRDDEGVLSLDPQLPDGISRLRFRLRWRDFRVTVDVNHADVTYTLRDGPGGELTIQHAGAELELSTQSPTTVAVRPRKPLLPPPQQPPGREPTHRRAVSRSSPGQ

SEQ ID NO: 4933 - protein, 362 aa, Mycobacterium paratuberculosis
MTGIDFSLLDVPRAAPVDDPEAYLRAVIAWHFGADTGSPFWLRTARTLSFDPLTDVHTFDDLRRFPNLVNELRHVAVGDLIPRGYPAQDRPLIFESGGTTGAPKRTVQMPDWVAQVVDWQTEDFAAGGFRRGEGFLCMMPSGPHGVGYFSRLVSQRLSAVFHAVDIDPRWVKKLAARDAAADVAGYVEHVVEQAVFVLQTQDVANLHTTGPLLAAMARDDRVVELVDAKIGYLLLSGAHVDADTLDLLRGIFPRTTITMAFGSTMVLSQAVTRTDGDTFVFDPRTPYVVFWVVDPDTGERVRYGQPGQVVMHHLSRTMFIPNNLERDLAVRRPGPAGELSDSLSEVRPVQSFEGEAVIEGVY

SEQ ID NO: 4934 - protein, 408 aa, Mycobacterium paratuberculosis
AAPLPPADRRAALSRAAEVFTDGVIAGLDFEAYAGLAARISGLPVAITRAAARGVADGLAGAFDAVASARPAGAVPDWREPRVRGGGALWVRRGEVFAVHAAGNGPGVHGLWPQALALGYRVAVRPSRREPLTGHRLVTALRQAGFRPHDAVYLPTDHAGADEIIASADLAMVYGGQRVVDKYAADPAVIVNGPGRSKIVITAEQDWRECLDVVVDSVARHGGMACVNATAVLYEGDPAPLAAAVAERLAAIEPLPADDERAMLPTLPLPRARTLANYLAAKAAGATTLLGADQVVADLGGGQAALRPAVHVLTEPDPELLNLELPFPCVWVTGWSREGGRAAALAPLRRSLVVTAITGDDTLIDALVAEPTIGSVYRGCPTWSTAPGVPHDGYLADALMRTKGFIGD

SEQ ID NO: 4935 - protein, 255 aa, Mycobacterium paratuberculosis
VSAGHNGDMLARHVIRSLGSALVMAASGVAASAVSGSVIPTAAAQCPDVQVVFARGTGEAPGVGPTGQAFVDALHQRVGGRSFDVYPVNYPATDQWDTGIDGIRDAGAHVVSMAHDCPNTKMVLGGYSQGAAVMGFVTSPAVPDGIDPATVPKPLTPDVANHVSSVVLFGMPNVRAMNFLGEPPVVIGPLFQDKTLKVCATEDPVCSDGMNFAAHDTYADDGAMIDKGVSFASSHLGLGGPGAASVASGHGNFGE

SEQ ID NO: 4936 - protein, 312 aa, Mycobacterium paratuberculosis
VVQAARTNAAAKVNAIAQALDKVLNTVADRVANPARVSDPDRLRGAVGGRTVLVTGASYGIGEATARRLAAAGATVLVVARSEERLGELTAAINAGGGRAVAYPTDLTDESAVSALTKQITEEHGPLDVVVSNAGKSLRRSLHHQYDRPHDFQRTIDVNYLGPVRLLLGLLPAMRDNGRGHVVNVSSVGVRVVPGPQWGAYQASKGAFDRWLRSVAPELHADGVHVSTVYFALVRTRMIAPTPVLGRLPGLSPDQAADVIAKAVIERPRTLEPPWVLPAELASVLLAGPADRAARLWHRRFFSDAEEAGRER

SEQ ID NO: 4937 - protein, 521 aa, Mycobacterium paratuberculosis
VSAERVAPTAARALVRSGLLNPPSPRAVLRLLREASRGGTNPYTLLAVTAARWPGRTAIIDDDGALSYRELQRATESLARRLIRDGVAPGRAVGVMCRNGRGFVTAVFAVALLGADVVPISTEFRSDALAVALRAHHISTVVADNEFAERIAGADDAVAVIDPATAGAEESGGRPAVAAPGRIVLLTSGTTGKPKGVPRAPQLRSAVGVWVTILDRTRLRTGSRISVAMPMFHGLGLGMLMLTIALGGTVLTHRHFDAEAALAQASLHRADAFTAVPVVLARILELPPRVRARNPLPQLRVVMSSGDRLDPTLGQRFMDTYGNILYNGYGSTEVGIGALATPADLRDAPETVGKPVAGCPVRILDRNNRPVGPRVTGRIFVGGELAGTRYTDGGGKTVVDGMTSTGDMGYLDNAGRLFIVGREDDMIISGGENVYPRAVENALAAHPAVADNAVIGVPDERFGHRLAAFVVLHPGSGVDAAQLRDYLKDRVSRFEQPRDINIVSSIPRNPTGKVLRKELPG

SEQ ID NO: 4938 - protein, 1622 aa, Mycobacterium paratuberculosis
VKIPGVSSVVAGVAGGAAQVVRAGVSTAAGAAGALQTLASPVAELAGPVIQSMAQTTGRAIGLDGSADGAPAIVPPVRWHSGRRVHLDLVHSGRRVHLDLDPLLPFPRWHEYAPAVEEPVRRIPGVAKAHVEGSLGRLVVELADDADDAAVLDEVRSTVASVAADISWSKAEAAPPSAPFADPGNPLAILVPLTAAALDLVAMGAAVTGWVTRLPAAPQTTRAAAALINHQPRMVSILEARLGRVGTDIALAATTAAAHGLTQSFGTPLLDLTQRTLQISEAAAHRRVWRDREPQLASPDRPQAPVVPVISSAKSEVPRHSWAAAAAGEASHVVVGGTIDAAMDKAKGSMAGPVESYVDSAANGSLIAAVSALVAGGGTEDVAAAIEAGVPRAAHMGRQAFAAVLGRGLANSGQLVLDPGALRRLDRVKVVVIDGAALRGDHRAVLRVRGEAPGWDDDRVYEVADALLHGEEAPEPDPDELPATGARLRWVPSQGPSAMPAQGLESADLIVDGDRVGRVDVGWEVDPYAIPLFQTAHRTGARVVLRHVAGTEDLTASVGATHPPGTPLLNVVRELRADRGPVLLITALHRDFASTDTLAALAIADVGVALDDPRAATAWTADIITGTDLADAVRILSAIPVARSASESAVHLAQGGTTLAGLLLVTGEQEKGASPVSFRRWLNPVNAAAATALVAGTFSATRVLRLPDPTPQPLTAWHALDPEIVYSRLAGGARPLAVETEPSWRRRLDDLSYSPALAPLRAPLQNVLRLASATRTELADPLTPILAVGAAASAIVGSNIDALLVAGVMTVNAITGGAQRLRAESAAAELFAEQDQMVRRVVVPAVATTRRRLEAARHATRTATVSAKSLRPGDVIDLAAPEVVPADARLLEAEDLEVDESLLTGESLPVDKQVEPVAVNDPDRASMLFEGSTIVAGHARAIVVATGVGTAAHRAISAVADVETAAGVQARLRELTSKVLPLTLAGGAAVSTLALLRRASLRQAVADGVAIAVAAVPEGLPLVATLSQLSAAQRLTARGALVRAPRTIEALGRVDTVCFDKTGTLTENRLRVVCAVPDDVNPHDPFPELTAPQSAELVRAAARASARPQEGQGHAHATDEAILTAASSLNGQRDSDWSMIAEVPFESSRGFAAAIGTVGNANGNPSDTPVLILKGAPEVILPRCRFADPEADQQRAEAVVRGLAEQGLRVLAVAQRGWKHDTDDDDTDADAVDAAAHNLELLGYVGLADTARASARPLIEALLDAERDVVLITGDHPITARAIARQLGLPADARVVTGAELAGLDEDACAKLVADVQVFARVSPEQKVQIVAALQRCGRVTAMVGDGANDAAAIRMADVGIGVSGRGSSAARGAADIVLTDQDLSVLLDALVEGRSMWAGVRDAVTILVGGNVGEVLFTIIGTAFGAGRAPVGTRQLLLVNLLTDMFPALAVAVTSQYVEPDEAEYPSAADAEAARREHRRAVLTGPTPSLDAPLMRQIVTRGAVTAAGATAAWAIGRWTPGTERRTATMGLTALVTTQLAQTLLTRRHSPLVVATALGSAGVLVGIVQTPVLSQFFGCTPLGPVAWTGVLGSTAGATAISALAPNWLAKQVAALEPGQQDA

SEQ ID NO: 4939 - protein, 65 aa, Mycobacterium paratuberculosis
LVPVENLHSGDPITDCGQRYIVLESKTLNDCVVLELESRVDHQLQVIEKSFPTGYHVGRANHRVL

SEQ ID NO: 4940 - protein, 158 aa, Mycobacterium paratuberculosis
VRPVGSSLHCFPPRPAPRAALPQYFFLSGWPTVRSVESPDPAGTGVVERYLQCLAAHDWDGLAGTIADDGLTREGPFRDVIEGKAEYLDYLRRVLTELPGHRLEVQRVSHVDAGRCYVELTEAFDIDGATRRWPECILFERGGDGLISHISVFFKQGR

SEQ ID NO: 4941 - protein, 164 aa, Mycobacterium paratuberculosis
MSQPDALPMSWWVVGSEHTLSQQVPAPPAAVRDFYVDLDNLRLVHPLIVAVQTLFRGQTPDGYLHRYRVTDRIPLGPLALRINYRAQLLVRADGVVLTEADQSPGVRLRGTVSFAPAAAGTRITERIRIAAPRPLAPMTVRQAVKAHTAMLAGIRSHFANPVER

SEQ ID NO: 4942 - protein, 386 aa, Mycobacterium paratuberculosis
MKCRAAVIRGVGRDWEIAEIELDPPRSGEVLVRMAVAGICHSDDHLFTGDVVPTPEVVAASGQPAPDWFPLLGGHEGAGVVAEVGPNVTSVRPGDHVALSFIPACGSCRFCVNGQSYICDIGASLFQREMPTDGTCRRHLGAENLLAYGQLGTFAEYAVLSERSVIKIDEAIPFHAASLVSCGVSTGWGSATVSAGTEPGDTVVVIGAGGVGMNALQGARAVGAKYVVAVDPVAAKRDSAKIFGATHTAASARDAIPLVREITAGLMADRVVVCPGVVHVDLIPLALALLRKGGVCVLTGITPFTEPPVPLVLQEMTLSAKQLRGALYGGMNPRTSVPMLLSLYQAGDLKLDELVTRHYRLDEINEAFADLREGRNIRGVIDFASR

SEQ ID NO: 4943 - protein, 260 aa, Mycobacterium paratuberculosis
MADMQVAIVTGASSGIGLGCATRLAGTGMAVLGTGRDPKRLAELETAIGDPDRVATVAVDLTDDDAPRRIVDRALQRWGHIDFLINNAGVGSPKPLHETDDDTLDYFLNLMLRAPFRLAREVLPHLPPGSAIINVTSTFAVVGGLRGGAYSAAKGGLTALTTHIACQYGASGIRCNAVAPGVTVTPMVEKRLQDPRFRKINTEMTPHQRLGSVDDIAATVAFLCSPGGSFINGQTIVVDGGWSSTKYLSEYALTSEWIAP

SEQ ID NO: 4944 - protein, 517 aa, Mycobacterium paratuberculosis
VRSTLADAARAAAQRTPERIALVDNEVRLNCATLYAQAGELAAALLARIPAGSVVSFMLPNWHEAAVIYLAATLAGMVVNPILPSLRDHDLRFILEDACAAMVFVPHRYGGHDYPAMLDRVTAAMSAAPQVVVLRGPATGRTGRHTPYRCMLGGPPGGLPALDPDAVRMILYTSGTTSRPKGVLHTHNSIHALICQIRDHWAIDPGDTFLVPSPLAHIGGSIYAFECPLLLGTTAVLMDRWDPARAVALMTAHRCTHMAGATPFLQQLLSAAANARTRLPDLKVFICGGASVSPSLIRRAAAYFDRAVVTRVYGCTEVPVATVGAPRPQEADYAADTDGRPGIAEIKLAAHPAAPTGDGEICVRGPQMLRGYRHPEDDAESFDAAGFFRTGDLGRWALADSAGRYLVVTGRAKDVIIRSGENISAKEVEDLLADHPGIAEIAVVGLPDERTGERACAVIVPTPGASPDVAGLLALLVSKGVAKFKAPEQVVLWDALPKNDAGKVLKHRIRAALSKDG

SEQ ID NO: 4945 - protein, 249 aa, Mycobacterium paratuberculosis
MPQTISGDHRYLQIARALRKEIVDGVYPVGSQLPTEHQLCERFAVSRYTIREALRRLREDNLVASRPRAGTRVVPRPASSSYAQDAMSIDDLLAFAAGAQLTIESNAMVTIDDELAARTGLEPGTQWLSVRGYRQADGASVPICRTEYYINRSFAAVGRLLQRHAGPIFPLIEDLFGVSVAQLHQEIAAVLLSPELADGLGAEAGTAALQMRRTYTTSDGEVAQVTINTHLSPNFRYAMTMRRVTGQAG

SEQ ID NO: 4946 - protein, 560 aa, Mycobacterium paratuberculosis
LIASSPTADGRIPARMSISRAISTQPSRYATPGSPVPAIDVAPGWRLDRVTAPSRLFGANGLRTGPDGRIYIAQVTGSQISALDHHTGELETASPKGGDIVAPDDVAFDAAGNLYATEVMDGRVSVRDTGGRTRVLRDDVPSANGITFHRGRLFIGECREGGRLLEFDLAGGPPRVLLDNVPSPNAMEVGPDGLLYFPVMGANEIWRVDPDGGEPQCVATGLGVPDSVKFDARGHIVSTQVASGQVLRIDPRSGEQRVLAQLNPGLDNCTFVGDRLFVSNFTGEITEISPDGTTRSVLPGGLNWPLDLAVGHDGRLYVADGTYFYAALPDGALHTVGMLFSPGYPGFLRGVAASGPDEFVVTTSGGQISRYRPEASESEVLADGFDQLYGIAPGPAGVVVAELGTGRVLSLQRSGAVEVLAAGLREPVGVAIGHDGAALVAEAGAGRVVRVDGSKVDTVMADLQRPQGILLHGGVLYVVDAGAKELIAFDPADKTRRTIASGLPVGPPPGVNPKPLKGMPPFSGPQGPFAGITAAADGTLYVSADGEGSVLALRPTRDGH

SEQ ID NO: 4947 - protein, 275 aa, Mycobacterium paratuberculosis
MDDDLLRLEGRVVVVSGAGGGGIGTTVTAMAARAGATVIAVSRSKENLDEHIAPLAARGLAVLPVAADASTDEGIAAVIDQARRADGRLYGLVNVAGGAEPSTWMPSTRVSRTDWRKIFADNLETAFFMSQAVAAELLARRLPGSIVSISSISGMNTAPFHIAYGTAKSAIAAMTRTMALELAQSAIRVNAVAPGVTETAASRTYVADDPDRDRRAIATGDRDGPPRPARGAGRRHPVSALRAVELRHRPDAARRRRAGPAMESPRRRQHVAVPA

SEQ ID NO: 4948 - protein, 467 aa, Mycobacterium paratuberculosis
VMTDVAKDANSAVAEELSTPMTIGVEAYISEDYARAERDKLWRKVWQQVGRVEELPEVGSYLTYDILDDSIIVVRTGANEFRAHHNVCMHRGRRLIDTPEGAKNALGRTRKSFVCGFHGWTYGLDGACTHIREQQDWRQALTPDNTHLRPVRVDTWGGWLWINMDPDCEPLADYLFPAAKILEPFGLENMRYKWRKWLYFDCNWKVALEAFNETYHVYTTHPEFNKFGEFKGWAKAQGRHSNIGYDAPEDMEATKSKIRLGIGADPRVSTAEMQVYTMEETNATTTQTLVNAAKRLVDELPEGTPADKVLEHWLASARRDDEARGVIWPTIPPDILGQAGTAWQIFPNFQIGQGLTSALCYGARPHPSYNPDKCIFEVSVFELYPKGEEPQTEWEYTPVGDPRWRSVLPQDFSNMAAVQQGMKSLGFPGTKPNPYRERSTVNLHYQLSRYMGTGAPRELSDKEHPLA

SEQ ID NO: 4949 - protein, 615 aa, Mycobacterium paratuberculosis
VDTQQDGCGPTETPDDIDIDALRQKYAHEREKRLRKEGSKQYIELEDDFSGYYEVDPYTPVTPREPIREDIDVAVLGGGFAGLLSAAHLKKAGVDDVRIIELGGDFGGVWYWNRYPGIQCDNESYCYIPLLEELDFMPSKKFADGAEIYQHCRNIGKHFGLYDSAIFSTQVHDLRWDEQIKRWRVSTNRGDDIRARFVVLASGPFHRPKLPGIPGIKTFGGHSFHSSRWDYDYTGGDSGGNLHKLADKRVGVVGTGATGIQIVPFLARYAQHLYVFQRTPSTVDARNNTPTDPEWVKTLRPGWQRERQRNFHAWTFEGMAPGQPDLVCDFWTELGRNTAARVLALDDPASLTPEQFMAIREEEDYKIMERLRRRIDTLIDDPATAEALKPYYRFLCKRPCSNDDYLPSFNRPNVTLVDVSASKGVERATEKGLVANGVEYELDCIIYASGFEITTEISRRYSIETIAGRDGLSLFDYWRDGYKTLHGMTSRGFPNQFYTGFTQVGISANIAANYELQGEHIAYIIAEALKRGAATVEPSDEAQQQWCTTIRETAVDNSAFDAQCTPGYYNNEGGGGGEGIRSHLGEPYGPGFYAFEDLLRAWRDKGDLEGLVLGS

SEQ ID NO: 4950 - protein, 316 aa, Mycobacterium paratuberculosis
LSETLAPPLRFDDRVAVVTGAGRGLGRAYAHLLAARGAKVVVNDVGGALDGAGVDTGPAAQVVDEITAAGGDAVACTESVATPEGGRAIIETALARYGRLDVLVHNAGNVRRASLKQMSYEDFDAVLDVHLRGAFHVLRPAFPVMCRAGYGRIVLTSSIGGLYGNQGVANYAAAKAGVIGLSNVAALEGAAEGVRCNVIVPAALTRMADGIDTSAYPPMGAELVAPVVGWLAHESCSVSGELFIALAGRVARAVIAESPGVCRPGWTVEDVGEHLDAIRYVEAPLIFPVVPDGHAEHIRYSFELAQRANEQGALHG

SEQ ID NO: 4951 - protein, 389 aa, Mycobacterium paratuberculosis
MASPSGPMAGVRVIDLTAMVMGPYCTQIMADMGADVIKVEPPQGDNTRYISVGPAPGMSGVFVNVNRGKRSVVLDLQTDAGARALRGLVETADVFIHSMRAKAIAKLGFGYDDVAAINPAVVYTNCYGYGRRGPDRDRPAYDDTIQADYVGTIMADKIAGLTALYATTMALFHRERTGQGQEVEVAMFETMASFMLVEHANGALFDPPLGPAVYPRTVAPNRRPYRTSDGYIAALIYNDKHWNAFMNAVRPPWASELYATLEQRAAQIDTVYGLVAETMKERSTAEWLKLFGELEIPAAPLNSPGALFDDPHLNAVGMFQTVDTPHGPVRFPGVPTWFSQTPGRVAGPAPELGAHTDEVLAEIGASRRKSSRNAVPEADFASAREGKEL

SEQ ID NO: 4952 - protein, 568 aa, Mycobacterium paratuberculosis
MGVPVYQRILDLFQAEGVNTLFGIPDPNFVRMFLEAESRGWSVVSPHHELSAGFMAEAASRMTGKPGLCIGTLGPGMANIAGAIQCALVENSPVIFLGGQRARVTERRVRRGRIQFVRQEPLFAPSVKYSASIEYADQTDEIIHEALRRAMSGTPGPAYIEYPSHVILSELDVPDPLPPHRYRLVNQTAGEREVAEAVRLIRAAESPILLVGHGVHTSRTGAAVRELAELMACPVIQTSGGTSFIDGLQDRTFAYGFSPAAVEAVVTSDLCLALGTELGEPSHYGRTRHWAQNDATRKWILVEQDPAAIGVNRPIDVPLVGDLRGVVPQLVAALRDTPRKPSPDLDRWIEQDAAELAQLAENAPTGRTPIHPARFVVEATRAFPDDGIMVRDGGATVIFGWTYSQAKPRDVIWNQNFGHLGTGLPYAVGASIAEGGKRPVMLLTSDSAFLFHIAELETAARQGLPLVCVVGVDHQWGLEVGVYKRTFSQPSPQPGVHWSKDVRLDKVAEGFGCHGEYVEKEDEIGPAIQRSYASGKPAVVHVCIDPKANSEEMPKYDEFRTWYAEGTQ

SEQ ID NO: 4953 - protein, 478 aa, Mycobacterium paratuberculosis
MREYLKFYIDGQWVDPVRPNTFDVENPATEQVCGKISLGSAADVDVAVGAARRAFGRWSQSSREDRLDLLQAILAEYQKRADDLAAAVTEEIGAPPSLAAGPQVFLGIGHLTTAIEVLKNFPFTEQRGATLIAREPIGVCGLITPWNWPINQVAVKVYPALATGCTVVLKPSEVAPFSSYIFAEILAAAGVPAGVFNLVNGDGPGVGAALASHPDIDLVSFTGSTRAGVEVARNAAPTVKRVTQELGGKSPNIVLDDGGFADAVRAGVANMMPNSGQSCNAPSRMLVPASRMAEAISIAREVAEQVQVGDPDDATAIGPVASRAQFEKVQRLIQQGIDEGATVVAGGPGRPAGLDQGYYVKPTVFADVTNDMTIAREEIFGPVLCILGYDDLDHAVRLANDTDYGLAGYVSGADLDTAREVAGKIRAGWVTINHAFDLNAPFGGYKRSGNGREWSDFGFHEYLEVKSILGYAPAQGDQ

SEQ ID NO: 4954 - protein, 689 aa, Mycobacterium paratuberculosis
LTADTEPGGSHPAPARGTRPRWVAPVRRVGRLAIWDRPERRSGIPALDGLRAIAVALVLIGHGGIPGVSGGFIGVDVFFVLSGFLITSLLLDELGRTGRIELTGFWIRRARRLLPALVLMVLTVAAARQLLPERSLTGLRDDAIAAFLWMANWRFVAQKTDYFTQGAPPSPLQHTWSLGVEEQYYFVWPLLLIAVALALAARARRRCTRATVGGVRFSAFVIATVGALASASVAIAMATDGTRDRIYFGTDTRAQALLVGAAAAALLVSDWPSMNRGWCLLRTRWARRVARILPVLGLAGLAAATHCASGASGEFRHGLLIGVAIAAVAVIAPVAVEQRGVVARVLALPPLVWLGTISYGVYLWHWPIFLALNGERTGWAGMLLFAARCAATVAVAAASWWLLEQPIRRWRPARVPLLPLAAATVASAAAVTLLVVPVGTGPGLREAGLPPGVSAVAAVSPSPPGNSRPRDPNRPFTVSVFGDSIGWTWMHYLPPTPGFAFLDHTVIGCSLVRGTPYRYIGETLEQRPECDGWPIRWSRQVSQDQPDVALLIIGRWETVDRVNEGQWTHIGDPTFDAYLNGELERALNIVGSTGVRVVVATVPYSRGGEKPDGRLYPEDQPDRVNLWNTMLRKTVAHHPNVAILDLNKKLCPDGVYTAKVDGIKVRSDGVHLTPEGVKWLTPWLEESLR

SEQ ID NO: 4955 - protein, 203 aa, Mycobacterium paratuberculosis
MYSESKNQMSLLRERRGTFDQPMTAQQRADAMSEFYIPVTPEAGRLLYSLVRATRPATVVEFGMSFGISAVHLAAAVRDNGSGRVVTTELSETKIAAAKKTFAETGLDDVITILQGDALTTLADLPGPVDFVLLDGWKDLYLPVLELLEPRLSPGVLVVADNTSAADTQPYLDRVRNPDNGYVSFNFQVRDSDSMEISCRTSG

SEQ ID NO: 4956 - protein, 56 aa, Mycobacterium paratuberculosis
LSPSGFRSPGYAVQCRSSDERGATGGVLRAGHRILFRSGGCGGTRVCLGREEVRAR

SEQ ID NO: 4957 - protein, 71 aa, Mycobacterium paratuberculosis
MAFVVTHRFPTVSRRRGWSMLRAGRLLANKFHQRTAMTPQERANLYVSRMPIAVITASLGGHPSGSADQHR

SEQ ID NO: 4958 - protein, 589 aa, Mycobacterium paratuberculosis
MTSMHTRGRRTPGAAVQSSAVSDAAHVGDIVGAFGRIRRDGGGADGAAGGRWRRLRTLAVITGPGLIVMVGDNDAGGVATYAQAGQNYGMGLLWTLVLLIPVLYVNQEMVLRLGAVARVGHARLIFERFGRFWGAFSVGDLLILNALTIVTEFIGVALALGFLGCPKIVAVPAAAALLFAVVAGGSFRRWERLMFLLIAVNVLIFPMVMLVHPAPKATVAGLIPQFPGGLNSTVLLLVVAIVGTTVAPWQLFFQQSNVVDKRITARWIPYGRADLVIGIVVVMVGATALMAVTAFGLAGTAAAGHFTDAGAVAAGLSAHLGRTVGVLFAIILLDASLIGANAVGLATSYAVGDAMGKRHSLHWKITEAPLFYGGYAVLLAVSAAVSFSPDHILGLVTQGVQALAGVLLPSATVFLVLLCNDRAVLGPWVNTVRQNIAAWTIVWCLVLLSLALTATTFFPDLSTGTIEAGLAAGAVLGVVAGAVMIVVGRRQRDLAEAEAIVRTLGGGLDPEQVDELDDASSLTRAERRAVRRQDRENWQTPSLALLDRPAMSPMRRAGLFTLRGYLVVAVVFVIIKLVQAGVVGPAGSL

SEQ ID NO: 4959 - protein, 341 aa, Mycobacterium paratuberculosis
MPNSRPVGSAAARLCWRRRAFDGEGNGMTAAAARAVRFDRYGGREVLYVADIEMPAPGPGEVVVEVRAAGINPGEAAIRVGALHERFPATFPSGEGSDLAGVVTAVGPGVTEFAVGDEVLGFSLRRSSHATHTAVPVGQLIRKPPELSWEVAGSLYVVGVTAYAAVRAVAPQPGETVAVSAAAGGVGSLVTQLLVLRRARVLGIAGPGNADWLRAHGVVPIAYGDGLADRLREAAPDGIDAFIDLFGPQYVQLAVDLGVPPERIDTIISFEKAAEVGAKTEGSAEASTPEVLAEMADLIVSGALEFDIAATYPLDRVADAFAELEQRHTHGKIVLLPTDSQ

SEQ ID NO: 4960 - protein, 205 aa, Mycobacterium paratuberculosis
LGEGSCVQAARIGIAGCAAVVIAAAGCGGGGKGSSPGSGSPTPPSSSGAVTGPPPGQPSDYGYLLIKPSDVGGGLSAPQSPMLNPNNAPGAAQLFANADSSRRLWDTIVIAADAPAATAELAATKSSYAGKVNGDWRPVAVGANGTTISGGSSDNTQAMTVLLFTEGRALVTLEFDSAPNDPIDPAVAVDIARKQDAAIRTGLPG

SEQ ID NO: 4961 - protein, 252 aa, Mycobacterium paratuberculosis
MRRAGRYLFVMVAITVMALVAPVGRGGASVPLPQPVPGIASILPANGAVVGVAHPIVVTFTAPAADRAAVERSIHVVSPAGVRGHFEWADDNTVVRFVPNRYWPAHGHVSVGVQALTTGFDTGDALLGVASISKHTFTVSRNGEVLRTMPASMGKPSRPTPIGNFTALEKQRSVVMDSRTIGIPLSSPEGYKITAQYAVRVTWSGVYVHSAPWSVDSQGYANVSHGYINLSPDNAAWYFNEVNVGDPIQVVA

SEQ ID NO: 4962 - protein, 250 aa, Mycobacterium paratuberculosis
LLSADHRFQQTMTVRLGRRGRVPITGWVQSRRGVGMAGEDHYTRPCADSAALVLIDVQRDFYADDAPMRVEGTSAALGAMAELARPFRRRELPIVHVVRLYRADGSNADPVRRRFIEDGARVAVPGSPGSQIAPELLPKAVELDHQLLLSGGFQQIGPAEHVMYKPRWGAFYGTKLVQHLRESGTDTLVFAGCNFPNCPRTSIYEASERDFRIVLVADAISGLYDRGAQECRAIGVAVRDTAQTLDWLGG

SEQ ID NO: 4963 - protein, 312 aa, Mycobacterium paratuberculosis
VRVLFRQLEYFVAVASERHFARAAEKCFVSQPALSAAIAKLEKELNVTLINRGHSFEGLTPEGERLVVWARRILAEHDAFKAEVDAVRSGVTGTLRLGTVPTASTTASLLLSAFCSAHPLVKVQILSRLSAGELYRRLREFELDAAIAHTAPDDIPDVNLVPLYRERYVLLAPADLLASGAATMTWVQAAQLPLALLTPDMRDRQIIDRAFADHGITLHPQVETDSVASLFAQASAGSWASIVPHTWLWASPLGAGIRAVELVDPVLTADVVLATKSHGPGSPIARALAASAGRLQLNDFFDAQLLGVTRRR

SEQ ID NO: 4964 - protein, 410 aa, Mycobacterium paratuberculosis
VSTWTSPATSWARPWTLRPPPARCGGVVDPAPRQLPAPEAVDRALDVLADARRPLIVLGKGAAYAQADNEIRRFVESTGIPFLPMSMAKGLLPDAHPQSVAAARSLAIGRADAVLLVGARLNWLLGHGESPQWSAGVKFVQVDIEPSEFDSNQQIAAPLAGDIGSVMSALCDALAARPITVPARWTEELAERRAHNDAKMRERLAEDPHPMRFYNALGAIRAVLQDNRDVYVVNEGANALDLARNVVDMELPRHRLDTGTWGVMGIGMGFAIGAAVETGRPVVAIEGDSAFGFSGMEIETICRYRLPVTVVILNNGGVYRGDEAPHGDDPAPTVLSARARHELIAEAFGGKGYHVSTAAELRAALTEAIGSGGPSLIDCELDPTAGVESGHLANRNPASAASPAAVSAGA

SEQ ID NO: 4965 - protein, 512 aa, Mycobacterium paratuberculosis
MAGQYPHPHGRSRHMSATSASAGPAPESARLIDGFHLVVQALRANDVATIYGIVGIPITDLARVAQASGIRYLGFRQEASAGNAAAAAGFLTRRPGVCLTTSGPGFLNALPALANATTNCFPMIQISGSSDRALVDLRRGDYQDLDQLDAARPFAKAAYRINRVDDIGRGVARAVRTAVSGRPGGVYLDIPGDVLGQAMDASAAAGTLWRGRRPRPPPAARARGGRSRAGRSGRRPAAVDRAGQGRGIRPGRQRDSAIRRVNRDSVPADVDGQGAATGRAPAVRRGRAVAGHRARRRGAVGRRPVELASGTWGIAAMVGRRQVRPGRHRAVGVRQQPADRRAAGRRHRLGDVRAVRRAGRPADHRTGAVDRGTGRAPGPQRRQDARAPRRGPAPDAVLQRAGRDSRCAARQPRRLRGQRGSQRARPGPQRRRHGTASAPARHRNLGRDGHRHGLRHRRRGRDRSAGGRDRGRQRVRLQRDGDRDHLPLPPAGDRRHPQQRRCLPRRRGPARG

SEQ ID NO: 4966 - protein, 529 aa, Mycobacterium paratuberculosis
VAMTSEATPSATAAGPRLADLVEAAAQRAPRAPALLVASERNPIAYADLVRLVDDLAARLRAAGLGPGDRVGLRAGSNPEFVVALLAASRADLVVAPLDPALPAADQLSRSRAVGARAVLVDRLGEGQTAPESAPCWPVTVTVGPDDGAPTVDLTVTAAPTHDVTAPQGLRDDDAMIMFTGGTTGAPKMVPWTRHNIAASIRSIVAGYGLGPRDATVAVMPLYHGHGLLAALLATLASGGAVLLPARGKFSAHTFWDDIAAVGATWYTAVPTIHQILLERARTEAPRGTHALRFIRSCSAPLTAETAQALQDTFGAPVVCAFGMTEATHQVSTTAIDGAGHSENPGATPGLVGRSTGPDIRIAGPDGQSLPADTVGEVWLRGATVVRGYLGDPAITAANFTDGWLHTGDLGTLSAAGDLVIRGRIKELINRGGEKISPERVEGVLAGHPDVLEAAVFGRPDQLYGETVAAVIVTRGSAAPTADELASFCRERLAPFEVPAEFRRAAELPHTAKGSLDRRAVAEQFGESA

SEQ ID NO: 4967 - protein, 720 aa, Mycobacterium paratuberculosis
MADKTTTSQGAGNAPTAKSPGEIRNVVLVGPSGGGKTTLVEALLVAAGVLNRPGSVADGSTVCDYDEAEIRQQRSVGVAVASLSHDGVKVNLVDTPGYADFVGELRAGLRAADCALFVIAANEGVDEPTKLLWQECNQVGMPRAVVITKLDHARANYAEALAAAQNAFGDKVLPLYLPTGLPACTGLIGLLSQQRYAYADGKRAVRPPDPADAAQIEAARGTLIEGIIEESEDESLMERYLGGESIDETVLIADLERAVARGSFFPVIPVCSSTGVGTLELLEVATRGFPSPMEHPLPEVFTQVGAPRAGLACDPDGPLLAEVVKTTSDPYVGRVSLVRVFSGTIRPDATVHVSGHFASFFGTGNGNGHAHPDHDEDERIGVLSFPLGKQQRPASAVVAGDICAIGKLSRAETGDTLSDKSEPLVLKPWTMPEPLLPVAIAAHAKTDEDKLSVGLGRLAAEDPTLRIEQNQETHQIVLWCMGESHAGVVLDALANRYGVTVDTVELRLPLRETFAGKAKGHGRHVKQSGGHGQYAVCDIEVEPLPEGSGFEFVDKVVGGAVPRQFIPSVEKGVRAQMEKGVHAGYPVVDIRVTLLDGKAHSVDSSDFAFQMAGALALREAAAATKVVLLEPIDEISVLVPDDFVGAVMGDLSGRRGRVLGTDTAGHERTVVKAEVPQVELTRYAIDLRSLAHGAASFTRSFARYEPMPESAAARVATAAV

SEQ ID NO: 4968 - protein, 145 aa, Mycobacterium paratuberculosis
VGEFDARARFGRASVARLATVSPGGQPHLVPVVFALAQGPDADHDADPDVVYTAVDAKPKTTRRLRRLANIDANPQVSLLADHYADDWTRLWWVRADGLATIHRDGPALDTGYRLLRAKYPQYQSVPLDGPVIAIAVRRWSGWAP

SEQ ID NO: 4969 - protein, 361 aa, Mycobacterium paratuberculosis
MSKSHHHRSVWWSWLVGVLTVVGLGLGLGSGVGLAPASAAPSGLALDRFADRPLAPIDPSAMVGQVGPQVVNIDTKFGYNNAVGAGTGIVIDPNGVVLTNNHVISGATEISAFDVGNGQTYAVDVVGYDRTQDIAVLQLRGAAGLPTATIGGEATVGEPIVALGNVGGQGGTPNAVAGKVVALNQSVSATDTLTGAQENLGGLIQADAPIKPGDSGGPMVNSAGQVIGVDTAATDSYKMSGGQGFAIPIGRAMAVANQIRSGAGSNTVHIGPTAFLGLGVTDNNGNGARVQRVVNTGPAAAAGIAPGDVITGVDTVPINGATSMTEVLVPHHPGDTIAVHFRSVDGGERTANITLAEGPPA

SEQ ID NO: 4970 - protein, 590 aa, Mycobacterium paratuberculosis
MNDAREAVEHHPEEGSHVQDGVVEHPEAEDFDNAAALPTDPTWFKHAVFYEVLVRAFFDANADGAGDLRGLLAQLDYLQWLGIDCIWLPPFYDSPLRDGGYDIRDFYKVLPEFGTVEDFVALLNAAHERGIRVITDLVMNHTSESHPWFQESRHDPDGPYGDFYVWSDTSDRYADARIIFVDTEESNWTFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPADVVEYFGDPSTGGDECHMAFHFPLMPRIFMAVRRESRFPISEILAQTPQIPEMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRTPMQWTPDRNAGFSKANPGRLYLPPSQDPVYGYQAVNVEAQRDTSTSLLNFTRTMLAVRRRHEAFAIGTFEELGGSNPSVLAFVRQVSNDGDTVLCVNNLSRFPQPIELNLQHWSGCIPVELTGHVEFPRIGHLPYLLTLPGHGFYWFQLTACEEDT

SEQ ID NO: 4971 - protein, 452 aa, Mycobacterium paratuberculosis
MTEPAKLPWSDWLPQQRWYAGRNRRLTGAEPSVIVGLRDDLDLVLVDADYADGSRDRYQVLVRWDAAPVSEYSTVATIGAADDRTGFDALYDDEAPQFLLSLIDSSAVRSASGAEVRFAKEPDAQLPLEAMAHVSDAEQSNTSVIFDRDAIFKVFRRVSSGINPDIELNRVLGRAGNPHVARLLGTYEMAGADGTPETAWPLGMVTEFAANAAEGWAMATASVRDLFAEGDLYAHEVGGDFAGESYRLGEAVASVHATLAETLGTSQAAFPVDNVLARLSSTAALVPELTEYAATIEERFAKLATETITVQRVHGDLHLGQVLRTPESWLLIDFEGEPGQPLEERRAPDSPLRDVAGVLRSFEYAAYGPLVEQGAQNTDKQLAARAREWVERNRTAFCDGYAAASGIDPRDSAPLLAAYELDKAVYEAGYEARHRPGWLPIPLRSIARLTTA

SEQ ID NO: 4972 - protein, 228 aa, Mycobacterium paratuberculosis
VPSEINNSETRLSWVLAVLAGVLGATAFTHSAGYFVTFMTGNAQRAMLGYFRGDVVLSVTAGVLIVCFVAGVVIASVCRRHFWVDHPHGPTVLTTFSLVAATLVDVIDEGWEENLLDFAPIMLVTFGIGALNTSFVKDGEVSVPLSYVTGTLVKMGQGIERHIAGGTAADWLGYFLLFASFVVGATVGGFISLFVNGTSMLVAATVMCALTTGYTYFHSDRRALLDEA

SEQ ID NO: 4973 - protein, 352 aa, Mycobacterium paratuberculosis
MSFIEKVRKLRGAAATMPRRLAIAAVGASLLSGVAVAAGGSPVAGAFSKPGLPVEYLEVPSPSMGRNIKVQFQGGGPHAVYLLDGLRAQDDYNGWDINTPAFEEFYQSGLSVIMPVGGQSSFYSNWYQPSSGNGQNYTYKWETFLTQEMPLWMQSNKQVSPAGNAAVGLSMSGGSALILAAYYPQQFPYAASLSGFLNPSEGWWPTLIGLAMNDSGGYNANSMWGPSTDPAWKRNDPMVQIPRLVANNTRIWVYCGNGTPSDLGGDNVPAKFLEGLTLRTNEQFQNNYAAAGGRNGVFNFPANGTHSWPYWNQQLMAMKPDMQQVLLSGNITAAPAQPAQPAQPAQPAQPAT

SEQ ID NO: 4974 - protein, 315 aa, Mycobacterium paratuberculosis
VSVDNAAAATLVRAPRGWQRVGALSSRIGAFAIVEMQKLQHDRTELVTRMVQPALWLLVFGTTFSHLHMINTGSVSYLAFLAPGIIAQSALFISIFYGIQIIWDRDAGVLAKFMVTPAPASALVTGKAFAAGVRSLAQVVGVLALAYLMRIGLTVNPLRILAAMGIVMLGAAFFACLSMTLAGLVRNRDRLMGIGQAITMPLFFASNALYPVELMPTWLHVLSKINPLSYEVNALRAEQDQPAQLRGQRAAGAADRHTLQPGRHRGAGGGGGDRNPHGLNTSAPPGRLGLLVPLAHAPSRRKIAARFRESIVTRP

SEQ ID NO: 4975 - protein, 387 aa, Mycobacterium paratuberculosis
VAGRAAARDLGQRRGRRARPGAQHRLDPGHQAGVGRIPAARRRGHRPPGVPAAAHRVRAADRRRVPGRPAGIAVRGGRRTRRRPNRGSDKRIGGPRHDDPKTAGAATMTGPLPVAIDAKHLTYRYGQFTAVDDVTLQVRPGETMGLLGPNGAGKTTMVRMLTTLAPVQQGELHIFGLDARRRTTDIRANIGYVPQQLSVEPALTGRQNVAWFARLYGVPGAERAQRVDQALAAMDLLDVADRLASAYSGGMIRRLEVAQALVNRPSLLVLDEPTVGLDPIARDGVWEHVQKMQARFAMTVLLTTHYMEEADALCDRVALMHRGALRAVGAPDELKARISRVSPHATLEDVFRHYAASDLGGDDAAHPRPSGSIRQVRSSRKVARRVG

SEQ ID NO: 4976 - protein, 212 aa, Mycobacterium paratuberculosis
MSPGSCRAASALRVRPLSIAISIYTLPRMVYAAALVRVTAPGTHNGRVRLLLIADTHIPGRARDLPAQVWDEVAGADVVIHAGDWTAPEFFDELDGRAARLVACWGNNDGPALRARLPERADVTLAGVRFTVVHETGAAAGREARMSRRYPDSQVLVFGHSHIPWDTTTRTGLRLLNPGSPTDRRRQPFCTYLTACAADGAVSDVVLHRLTK

SEQ ID NO: 4977 - protein, 100 aa, Mycobacterium paratuberculosis
MAIDSGRTRKADAARHDPGDIDVVLTRLRRAHGQLGGVIAMIEQGRSCKDVVTQLAAVSKALDRAGFKIIASGLRDCITRTEQQPPLSIDELEKLFLSLA

SEQ ID NO: 4978 - protein, 133 aa, Mycobacterium paratuberculosis
VTSKLSTTLHTSFPDAVDRITKALADQGFGVLTTIDVKATLKQKLGADMEDYLILGACNPALAHRALGIDRQIGQLLPCNVVVRSDPAEGDAVLVEAMDPQLMVKVTGEAGALQEVADQATAKLQAAISALAG

SEQ ID NO: 4979 - protein, 278 aa, Mycobacterium paratuberculosis
MPDVIAHHGLLKDTRLHVDDTGGPGRPVLLMHPWPLSGQSWSAQVPVLHAAGYRVVTYDRRGFGRSDKPLTGYSYSQLTQDLHTLVESLDLRDLTLVGSSMGGGEVARYLSTYGPERVRSVVFASSVTPYLLQTTDNPDGPLTMKDAARATASFVKDQDAFYDHQMTEFFSANGQLRVSRATRAEALRLCKQAGKEASLACMAAWANTDFRPDLTRVSVPALIIHGEGDESVPLAGSARRTHRAIPGSRLCVIADGPHGCHISHAQEFNAALLDFLAA

SEQ ID NO: 4980 - protein, 151 aa, Mycobacterium paratuberculosis
MRTFESVADLAAAAGETLGHSDWVTITQEDVNLFADATGDHQWIHVDPERAASGPFGTTIAHGFMTLALLPRLQHQIYTVNGIKLAINYGLNKVRFPAPVPVGSRVRAQSSLVGVDDLGNGAVQATVSTTVEIDGSAKPACVAESIVRYIS

SEQ ID NO: 4981 - protein, 449 aa, Mycobacterium paratuberculosis
VASSTSPARRGAGEWLATVWDFETDPEYQAKLDWVEKFMAEELEPLDLVALDPYDKKNAEMMAILRPLQQQVKDQGLWAAHLRPELGGQGFGQVKLALLNEILGRSRWAPSVFGCQAPDSGNAEILALFGTDEQKARYLQPLLDGEITSCYSMTEPQGGSDPGQFVTAATRDGDYWVINGEKWFSTNAKHASFFIVMAVTNPEARTYDKMSLFIVPAETPGIEIVRNVGVGAESSSRASHGYVRYTDVRVPADHVLGGEGQAFMIAQTRLGGGRIHHAMRTIALARSAFDMMCERAVSRKTRHGRLADFQMTQEKIADSWIQIEQFRLLVLRTAWLIDKHHDYQKVRRDIAAVKVAMPQVLHDVAQRALHLHGALGVSDEMPFVKMLVAAESLGIADGATELHKMTVARRTLREYEPVSTPFPSAHIPTRRAEAQARLAERLEHAVAEF

SEQ ID NO: 4982 - protein, 233 aa, Mycobacterium paratuberculosis
MDAVDPDSRHQLAVRMAELVRGMAAPRRLDQVLAEVTAAAVEVIPGADIAGVLLVRKGGEFETLADTDSLAARLDVLQHDFGEGPCAQAALQETIVRSDDLRREPRWPRYAPAAVQLGVLSSLSFKLYTADRTAGALNLFSHRPDAWDTEAETIGSVFAAHAAAAILAGSRAEQLYSAVSTRDRIGQAKGIIMERFGVDDVRAFDLLRRLSQESQVKLVEIAQQIIDTRGQGA

SEQ ID NO: 4983 - protein, 376 aa, Mycobacterium paratuberculosis
VCVRPAVAGMPTGVTGISRRTLGRLAVGAGVLASAVQACAKPGAGHGRSGAPPAPAGKGVGFVLSHEQFRTDRLVAQAQAAERAGFTHVWASDHIQPWQDNEGHSMFPWLTLALVGSSTSHVSFGTGVTCPTYRYHPATVAQAFASLAILNPGRVFLGVGTGERLNEQATTNGYGNYTERHERLAEAIALIRQLWSGSRISFSGRYFQTNSLKLYDVPATPPPIFVAAGGPKSAKLAGQFGDGWITQSGDVTNPKLLAAFGAGAQAAGRDVATLGKRAEMFAVVGDDAVAARAATLWRFTAGAVDQPDPVDIQRAAESNPTDKVLGGWTVGTDAGRHVEAAQRVLDAGAVPFLHFPQDDPMVAIDFYRDNVLPKLR

SEQ ID NO: 4984 - protein, 201 aa, Mycobacterium paratuberculosis
MTPQVRPADRADIRALSATLARAFYDDPVMVWLFPDRRKRIARLSRVFATMTRHHHLAGGGVEVACAGAGIGAAALWDPPHRWRETPRAQLAMTPTYLRVFGLRSMRGRAVQELMKSVHPEEPHWYLAVIGSDPGVRGQGFGQALMRSRLDRCDAEHCPAYLESTKPENVPYYQRFGFTVTREIVLPDGGPSMWAMWRPPR

SEQ ID NO: 4985 - protein, 117 aa, Mycobacterium paratuberculosis
MSDNPRGDELVDPADLPEEGGPGDTLNASEGTDSDEVRNDDGDIVVDPPEGWSEADRFGVTAGEEREGESLDDRLAAEEPDVPDAIEPVDDLPRRAHRGQVDGTPEDGDSLYDVVDE

SEQ ID NO: 4986 - protein, 190 aa, Mycobacterium paratuberculosis
IIAAALKLLQDRSFSSLSLREVTREVGIVPAAFYRHFESMESLGLVLIDESFRSLRDTLRDARAGKLDPNRVIESSVEILVASVADRREHWRLIARERNSGLSVLRYAIRTEIRLITSELATDLARFPGLHEWTTEDLNVLATLFVNAMIVIAEAIEDSQSAEAREDIRRLAVKQLRMIATGIAGWHSTP

SEQ ID NO: 4987 - protein, 364 aa, Mycobacterium paratuberculosis
MFTQTVQASGRVLARTVRQRVLGSELLDLLTGPHGVDRYTELVAPTWTLGEARAKVTDVRRTTPRSVTLTLEPNDTFLSSHTVTAGQYVNLTVEIDGRRHTRCYSPANREGTATLELTIGRHDGGLVSNHLYDHARRGMVVGLAGVGGDFVLPTPRPRRVLFVSGGSGITPVMAMVRTLVSQRHRGEIAFIHYAPTPAEACYREELAALPSVRVLHGYTRSAGGDLSGRFGPDHLAAAMPAPDAVFVCGPTSLVDAVREHCDNVYTESFTPPVLEAPADPSGGRVTFSDSGVDVVDDGRSLLEQAEAAGLSPQNGCRMGICHTCTRRKTAGTVRNLVTGAVSTAPDEDVQICVSVPVGDVDLSL

SEQ ID NO: 4988 - protein, 366 aa, Mycobacterium paratuberculosis
VTHNKITLTPEQAEEFGRELDALKERVMADLGEKDADYIRRVIKAQRALEVGGRALLFLPPAWLLGTTMLGLSKILDNMEIGHNVMHGQYDWMRDPAISGRSFEWDTACPADQWRHSHNYMHHTHTNIVGMDRDIGYGILRMSEDQPWQPYFLGNPLYAFLLMVLFQYGVALHELETERIRSGEIRLADKREVLREIWQKTRRQTLKDYVAFPLLAGPFAPFVFTGNLAANLIRNVWSYMIIFCGHFPDGTQEFTVEETQDESRGMWYFRQILGSANLTGGKLFHLLSGNLSHQIEHHLFPDMPARRYAEIAPEVQAICQRYGVAYNRGPLLRQFGTVVRKIVKLSFPDAWVPGAAKPADREPVAA

SEQ ID NO: 4989 - protein, 370 aa, Mycobacterium paratuberculosis
MTHESTAAWRELLAALGELDRSFLEGDRAVSDDRHIADGYRMLATTLGVAFDTYLFPEPDRPQFVAVNTPFRRDRRWGGDNTDAYYFICPVDPKRRYRISGNKGDSVYFSVTAYNEPSLGAWSDRVVAIVRDSDLDVDADGNFSFEFPPTPDAAVLMTRDYQADPLTGRPVTWRIEALDEPAPIRHGDAETAARLRAVATWLRTMFAIVPLAVGNRVDDQHALGHETAHAANAFADPYQVPDANFGWSARDACYSYGSFVLDDDEALVITHRPPSCRFWNMVVWNQFMATYGAAEGPDARCSINGHSAVANSDGTVTIVLSRDRTPHPNSVTTLGYPRGNLAFRWFLADGVPARPEVELVKAADAPTAVR

SEQ ID NO: 4990 - protein, 223 aa, Mycobacterium paratuberculosis
MSRICWPSALNCGSARSSRRTVTPTYVTLSFVMVVDFGRPRDPRIDAAVLRATVELLAETGYPGLLVSAIAQRAGTSKPAIYRRWPSKAHLVHEAVFPVGADTAIPDTGSTADDLREMVRRTMVFLTTPAARAALPGLIGEMAADPSLHSALLERFAGAIGGGLADWLAAAAARGEARPDVTAAELAETIAGVTLVALLTRPTELDDAWVDRTTRLLLKGISA

SEQ ID NO: 4991 - protein, 386 aa, Mycobacterium paratuberculosis
MAAMAPQCPLDADALHAQASADTGLHDFGPDDYRERLAVYLTALREIDGLHAAGTVNFYGQLLQILKNRLLLTDLLKRHPEIHDIELHSPVVIAGLPRTGTTHLHNLLAAPPTFRTMPYWESVEPFPMPNEVGVQPDPRRTRMDVAVGVINTVMPHFALMHEMTTDHVHEEIQLLANDVSTMLLETLAEVPRWRAYYQAHDQTPHYEYLATQLRAMQFLRGGRRWLLKSPQHLEQVPVLDRVFPDSIVVFTHRDPVPVALSMIAMITYSARMHRSPVPVRQIAESWIDRLGQMLAALVRDRDVIGPDRSIDIRFDDFMADELGVAERVYALADEPFTDDARAAVADYLAGHRRGRLGNVETSFEMFGLDEESLRERFAPYVERFLA

SEQ ID NO: 4992 - protein, 296 aa, Mycobacterium paratuberculosis
MVTMPELDGVEHRYVDLGDDVTIHVADAGPASGPAVMLVHGFPQNWWEWRALIGPLAADGYRVLCPDLRGAGWSSAPRSSYRKDEMADDLAGVLDRLGVRSVDLVAHDWGGPVAFIMMLRHPEKVTGFFGVNTSAPFVKRSLSTIRNVWRFWYQIPISLPVIGPRVISTPDSRFVRLLGSWVGGGYTLPEEDVRLYLECMRQPGHAEAGSRWYRSFQTREMLSWMRGEYDGARVHVPVRWLSGTEDPVLTPDLLDGYAERIDDFQLELVDGVGHWIVDQRPDLVLDRVRAFLRRET

SEQ ID NO: 4993 - protein, 70 aa, Mycobacterium paratuberculosis
MRLSTRNQLRGTITEVELGTVMAVVKVTLDGGDQVVTSSVTRDAATDLGLEVGKPATVFIKSTEVTIGVD

SEQ ID NO: 4994 - protein, 201 aa, Mycobacterium paratuberculosis
MTATDGEPDLGEIDPFRLRLLDGLATSIGERGYRASTVADVVRCARTSKRTFYDHFAGKEECFLELLAVDIEKLGAKIAASVDPEADWHVQIRQAVEAYVGYIEARPAITLSWIRELPSLGAAARPVQRRGLQLLTSLLIDLSASPGFRRAQLPPLTAPLAVILLGGLRELTALAVEDGKPVRGIVEPAVDASVALLGPRH

SEQ ID NO: 4995 - protein, 439 aa, Mycobacterium paratuberculosis
MHERSSHRPAGRGPPASRGPSPKLLQGIGFAVSRRTMMRRLSRRYGNVFTLRLPMWGPVVMVSDPQLAKQIFTTTPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRHYDGVIERLIAAEQADPNFAERTDVLALLLRSTYDDGAAMSHKEIGDELLTLLAAGHETTASTLAWAFERISRHPELLARLVEEADNGGNELRQATILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 4996 - protein, 171 aa, Mycobacterium paratuberculosis
MTNTQKAILAGGCFWGMQELIRKQPGVVSTRVGYTGGDVPNATYRNHGTHAEAVEIIYDPAVTDYRQILEFFFQIHDPTTKDRQGNDRGPSYRSAIFYTDDEQKRIALDTIADVEASGLWPGKVVTEVSPAGDFWEAEPEHQDYLQRYPNGYTCHYIRPGWKLPRRATSGS

SEQ ID NO: 4997 - protein, 168 aa, Mycobacterium paratuberculosis
VSSPQFSRSELVDAFANFEATVDAAAQSHDWDAWVEHYTPDVEYVEHAAGTMHGRDEVRQWIKRTMTTYPGSHMVAFPSLWSVVDEERGRIICELDNPMKDPGDGSVITATNISIITYAGDGLWSRQEDVYNPLRFLRAAMKWCRKAQALGTLDDAAAQWMRQNGGAQ

SEQ ID NO: 4998 - protein, 339 aa, Mycobacterium paratuberculosis
VSGKPKLVIGANGFLGSHVTRQLVADGAQVRAMVRAGANTRGIDDLSLTRFHGDVFDTAVLSEAMDGVDDVYYCVVDTRAWLRDTSPLFRTNVEGLRNVLDVAVTQPELRKFIFTSTYATVGRRRGHVATEDDVIGTRGLSDYVKSRVQAENLVMRYVAEAGLPAVAMCVSTTYGSGDWGRTPHGAFIAGAVFGKLPFTMEGIQLEVVGVTDAAKAMVLAADRGRVGERYLISERMIALKEVVRIAADEAGVPPPRRSISVPTLYALGALGDLRARLTGKDAELSLASVRMMRAEAPVDHSKAVRELGWQPRPVEESIREAARFWAAMRNAKGKSVTPR

SEQ ID NO: 4999 - protein, 126 aa, Mycobacterium paratuberculosis
MAHPEIKEPSAGHPITIEPTRGRVQVRVNGELIADSSAALELREATLPAVQYIPFTDVAQDRLTRTDTSTYCPFKGEASYYSVTTSAGDTVDDVIWTYEQPYPAVAAIAGHAAFYPDKAEISISTD

SEQ ID NO: 5000 - protein, 132 aa, Mycobacterium paratuberculosis
MTPFDDPQGELAWMFLQSTTEGGDLDEGFALLSDDFSYWTLYTRAACDKDTLRRAIERRKQDLELTIDLVRCVNEGETVVVEAQAAGTTSAGVEYDSPFVCIFDTRDGLIVSMRVYSDTRAVDNAMPGWIGY

SEQ ID NO: 5001 - protein, 321 aa, Mycobacterium paratuberculosis
LTWHAVHGQSGQIGEHRVKSSARTVVFPGAVSFGHTLAPLRRGLGDPCFLAPGDGSIWRTSLLPSGPVTARISRAGTNAVQCVAWGAGAAQFVDMLPAMLGSEDDASDFVPRHPTVAAAQRRVPHLRLGRTGLVLEALIPAIIEQRVPGADAFRSWRVLVSKYGTPAPGPAPERMRVPPSAQAWRSIPSWEFHRANVDPRRAQTVVTCARRAASLERLVSRPAAQARAALTSLPGVGEWTAAETAQRAFGDADAVSVGDYHIPKMVGWTLLGRPVDDAGMLELLEPMRPHRQRVVRLLEASGLAREPRRGPRLPVQQIHSL

SEQ ID NO: 5002 - protein, 182 aa, Mycobacterium paratuberculosis
MSEFTIPGLTDKQAARLTELLQKQLSTYNDLHLTLKHIHWNVVGPNFIGVHEMIDPQVEAVRGFADDVAERIAALGASPQGTPGAIIKDRSWDDYSVGRDTVQAHLAALDLVYNGVIEDIRQYIDETDELDQVTQDLLIGQAAQLEKFQWFVRAHLESAGGQLAHKGKSTERAAAQSARGKS

SEQ ID NO: 5003 - protein, 328 aa, Mycobacterium paratuberculosis
MPAVTANTLTLPRVGGPGPADTERPVRSITTGPRGYEGEGFPVVRAFAGVSTAALDPFVHMDQLGEVDYQPGEPRGTDWHPHRGFETVTYLLDGKFAHQDSYGGGGLITDGATQWMTAGSGILHIETPPAELVDSGGLFHGIQLWVNLPRKDKFTPPRYQAIEGGDVALLASDDGGALLRIIAGEVDGHHGPGVTHTPITLAHATIANGARLNLPWRRDFNALVYVLSGDGYVGPVAHPIRPGQLAVLGQGDRITVGAREVQDSGPDRGAIDVLLLGGRPIREPVFHYGPFVMNTRTELIEALQDYQAGKFGSIPPNALMPHRRDGTL

SEQ ID NO: 5004 - protein, 213 aa, Mycobacterium paratuberculosis
LRMLPRGNRRPGRPPAAKADETRQRIIQAARLVFSERGYDGATFQAIAARADLTRPAINHYFASKRALYQEVMDETNEFVIGVGIKEADRETTLVGRLTAFISAAVKANAENPAGSAFIFGGVLESQRHPEWNTAENDSVRIAREFLIRVVNDAIEHGEVAADIDASALVETLLVVMCGVGLYAGYVETYQEMLAVTGMLRQLLEGALWRPGS

SEQ ID NO: 5005 - protein, 313 aa, Mycobacterium paratuberculosis
MTDLDSSLPPSVRTAGDSWTITELVGATALGVAAARAAETAGPDPLIRDEFAGLLVSSASPAWARLADPELSWLDDDPHGKRAHRVGIDYQAVRTHYFDEYFDGALRAGIRQVVILAAGLDSRAYRLNWPAGTTVYEIDQPKVLEYKTETLQRHGATPAAVRRPVPVDLRDDWPAALTAAGFQAARPTAWLAEGLLPYLPSDAQDRLFEMVTALSAAGSQVAVEVFGMNSRSNAQRWLRMRERLGLDVNVAALTYHEPDRSDAAAWLARHGWRVHSVDNRDEMARLGRPVPEDLSDEAVRSTLLRAHLGGSTG

SEQ ID NO: 5006 - protein, 313 aa, Mycobacterium paratuberculosis
MSSLRTHDDTWDIKSSVGTTAVMVAAARAVETEQPDPLIRDPYAKLLVTNSGAGVLWEAMLDPDIAARVEALDEESAAHLHHMRGYQAVRTHFFDTYFADAVAAGIRQIVILASGLDSRAYRLDWPAGTTVYEIDQPQVLAYKSTTLAENGVTPSADRREVAVDLRQDWPAALRAAGFDPTQRTAWLAEGLLMYLPAEAQDRLFTLIGELSPAGSRVAAETAPNHADERRQQMRERFKKVADEIGFEQTVDVGELMYRDDHRADVTEWLNAHGWRATAEHSTAAMRRLGRWIENVPLADDKDAFSDFVVAERR

SEQ ID NO: 5007 - protein, 526 aa, Mycobacterium paratuberculosis
PGHREQWSAIMGSAGTGHPRRWVLLKGRLVASVASAFVMAVTGVGWTGYHTALGRIIISHALPNGAMSLGDNQNILLMGLDSRLDQNGRPLPPEIYDALHAGDESSGGYNANVLIIVHLSDGDGPVTAVSIPRDDYAELPGCPGSVCAGKIKQAYGLAYQQSLNAQAAGNSGAGATDLAAREQTAREAGRKAEIGAVTDFLGISVDHFVEVTLGAFFQIAKAVEPITVCLAGDTRDSYSGADFHQGVQRIDAAEAMAFVRQRRDENDGSFTDFDRTRRQQAFLVSLVEAARSGGALSSVSGLRKLLQVARDNVAVDAGLDLMQFAARASQLAGRPLSLYTLPISGFGKDPNGSDINLVDLPTIRRIVNERFMSDAPAALDAAVPGSQPPPAPAEPAVLDVVNATTHDGLAAALEEALAGRGFTRGSATTAPTQAEDSSIEYGPGAEAAARLLADQLHLPATAQSAVAPGTVRLTVGTAFPAADYLAHPGASGSGQVSTVSATGTGDHAPAPTDLSQMTATSVPCVK

SEQ ID NO: 5008 - protein, 488 aa, Mycobacterium paratuberculosis
MSGRRAARLCSGRTMMTTESVASKTTTSANGTASADIAGTVARLRQTFATGRTRDVEWRKRQLLQLQKLMEENEAAIAAALAEDLDRGPFEAYIADIATTAGEAKYAAKRVRKWTRRRYQLLELPQLPGRGWVEYEPYGTVLIIGAWNYPFYLTLGPAVGAIAAGNAVILKPSEIAAASSRVMAELVPKYLDNDAIAVIEGDGATSQELIAQGLDRVMFTGGTEIGRKVYEGAAPHLTPCTLELGGKSPVIVAADADVEVAAKRIAWMKLLNAGQTCVAPDYVLADAKIRDELVDKIGAAITKFTADKPEGMRVVNQRQFDRISSYLSGSDGKVTVGGACDPSTLRIQPAVVVDPDPDGPLMRNEIFGPVLPVITVQNLDEAIRFVNSRPKPLSAYLFTKTRETRERVIKEVPAGGMLINHLAFQVSTAKLPFGGVGASGMGAYHGRYGFEEFSHRKSVLTKPTRPDLSSFIYPPYTERAFKMARKMF

SEQ ID NO: 5009 - protein, 287 aa, Mycobacterium paratuberculosis
MPGVQDRVIVVTGAGGGLGREYALTLAREGASVVVNDLGGARDGTGAGHNMADQVVKEIKDAGGRAVANYDSVAEPAGAENIIKTALDEFGAVHGVVSNAGILRDGTFHKMLFENWDAVLKVHLYGGYNVIRAAWPHFREQSYGRVVVATSTSGLFGNFGQTNYGAAKLGLVGLINSLALEGAKYNIHANAIAPIAATRMTEDILPKEVLAKLTPEYVAPVVAYLCTEENPNSASVFVVGGGKVQRVALFQNAGVTYDKPPTVQDVAARWDEITDLSAAKQADFKLG

SEQ ID NO: 5010 - protein, 151 aa, Mycobacterium paratuberculosis
MIDEYRQFPTRNGAQRALHRVISLLGAGRAVLTHCFAGKDRTGFVVATVLEAIGVDRDVIVADFLRSNDAAPALRAQISAMIAQRQDTELTPEVVTWTEARLSDGVLGVREEYLAAARQTIDEKFGSLQAYLRDAGVGEADVQRLRAALLA

SEQ ID NO: 5011 - protein, 136 aa, Mycobacterium paratuberculosis
MPEALRELSGAWNFRDVADGAPMLRPGRLFRSGELSGLDDEGRATLRRLGITDVADLRAAREVARRGPGRVPDGVEVHLLPFPDLGEHEAGTDDQAPHEHAFQRLLTGDGGRAVGGVRRRGRHPLHDRRIPAIPNA

SEQ ID NO: 5012 - protein, 410 aa, Mycobacterium paratuberculosis
MDFAMSAKASDYHKRLTDFMTEHVFAAEAEYDKYRHEAGPHDHTVPPVVEQLKVKAKQQGLWNLFLPAESGLTNLEYAPLAEITGWSLEIAPEALNCAAPDTGNMETLHLFATEEQRKQWLEPLLAGEIRSAFSMTEPAVASSDARNIETSIVRDGGDYVINGRKWWTSGAADPRCKILIVMGRTNPDAASHQQQSMVLVPMDTPGVTVVRSTPVFGWQDQHGHCEIVYDNVRVPVTNLLGEEGSGFAIAQARLGPGRIHHCMRALGGAERALALMVNRAQKRVAFGRPLAEQGVVRESIAKSRNEIDQARLLCEKAAWTIDQHGNKAAHLLVSQIKAVAPKVACDVIDRAIQVHGAAGVSDDTVLARLYGWHRAMRIFDGPDEVHMRTIARAELGREKSALAAAVTAHA

SEQ ID NO: 5013 - protein, 137 aa, Mycobacterium paratuberculosis
LQKVQAAEDAWNTRDPDHVSLAYTPDSRWRNRDEYIVGRDQIVAFLTRKWQRELGYSLRKSLWDFHDNRIAVRFQYECRDRSGQWYRSYGNELWEFTESGLMARREASINDVPIDESQRRYFGPRPASEHGREIPLW

SEQ ID NO: 5014 - protein, 365 aa, Mycobacterium paratuberculosis
MTNAQANAVKVGVVAESGADERRVALVPKAVASLVGSGLAVVVESGAGERALLPDALYTEAGADIGDAWAADIVVKVAPPTADEVAKLHSGQTLIGFLAPRNADNSIGALKQAGVQAFALEAIPRISRAQAMDALSSQGNVAGYKAVLLAASESTRFFPMLTTAAGTVKPASVLVLGVGVAGLQALATAKRLGARTSGYDVRPEVADQVRSVGAQWLDLGIDAAGEGGYARELTEEERAQQQKALEEAIAGFDVVITTALVPGRPAPRLVTAAAVESMKPGSVVVDLAGETGGNCELTEPGKTVVKHDVTIAAPLNLPATMPEHASELYSKNITALLDLLIKDGKLAPDFDDEVVAAACVTRESA

SEQ ID NO: 5015 - protein, 105 aa, Mycobacterium paratuberculosis
MYDELLANLAILVLSGFVGFAVISKVPNTLHTPLMSGTNAIHGIVVLGALVVFGSVEHPSLAMQIILFVAVVFGTLNVIGGFIVTDRMLGMFKSKKPAKADEAAK

SEQ ID NO: 5016 - protein, 474 aa, Mycobacterium paratuberculosis
MNYLVIGLYIVSFALFIYGLMGLTGPKTAVRGNLIAAVGMAIAVAATLIKIRHTDQWVLIIAGLVVGVVLGVPPARYTKMTAMPQLVAFFNGVGGGTVALIALSEFIETSGFSAFQHGESPTVHIVVVSLFAAIIGSISFWGSIIAFGKLQEIISGAPIGFGKAQQPINLLLLAGAVAAAVVIGLHAHPGSGGVSLWWMIGLLAAAGVLGLMVVLPIGGADMPVVISLLNAMTGLSAAAAGLALNNTAMIVAGMIVGASGSILTNLMAKAMNRSIPAIVAGGFGGGGVAPGGGDGGDKHVKSTSAADAAIQMAYANQVIVVPGYGLAVAQAQHAVKDMAALLEEKGVPVKYAIHPVAGRMPGHMNVLLAEAEVDYDAMKDMDDINDEFARTDVAIVIGANDVTNPAARNEASSPIYGMPILNVDKAKSVIVLKRSMNSGFAGIDNPLFYAEGTTMLFGDAKKSVTEVAEELKAL

SEQ ID NO: 5017 - protein, 211 aa, Mycobacterium paratuberculosis
MPADSSTPNGQTRREELLAVATKLFAARGYHGTRMDDVADVIGLNKATVYHYYASKSLILYDIYQQAAERTLAAVHDDPSMTAREALYQYTVRLLDQIAANPEGAAVYFQEQPYITEWFTKEQVAAVREKETQVYEHVHGLIDRGIASGEFYECDSHVLALGYIGMTLGAYRWLRPSGRRSAKEIAAEFSTALLRGLIRDEEIRTTSPLGP

SEQ ID NO: 5018 - protein, 366 aa, Mycobacterium paratuberculosis
MAIRVAHVGTGNVGGLALAELITNPRYELTGVCVSTPEKVGKDAGELCGVGLDTGVVTGVAAVGDLDAVIAAKPECVVYCAMGDTRLPEAMADVMRILAAGINVVGSSPGLLQYPWGVMPEKYIARVEDAARQGNSSIFISGVDPGFANDLIPLALAGTCQRVEQVRCMEIHDYASYNGAEVMGYMGFGRPLDEIPMLLQPGVLSIAWGTAIRQLAAGLGIEVDEITESYQREPAPEDFDIAVGRVAKGTLAVLQFEIRGMVNGHPAIVIEHVTRLRPDLRPDLPQPAAGDGSYRVEITGEPSYAVDIVPSSRKGDHNHAAIAGAAGRIVNAIPAVIAAPPGIRTTLDLPLVTGKGLYAPSTLVTT

SEQ ID NO: 5019 - protein, 246 aa, Mycobacterium paratuberculosis
VGRVDGKVALISGGARGMGAEHARLLAAEGAKVVIGDILDDEGKAVADEIGDSVRYVHLDVTQPDQWDAAVETAVGEFGKLNVLVNNAGTVALGPLKSFDLAKWQKVIDVNLTGTFLGMRVAVEPMIAAGGGSIINISSIEGLRGAPMVHPYVASKWGVRGLAKSAALELAPHNIRVNSVHPGFIRTPMTKHLPDDMVTVPLGRPAESREVSTFVLFLASDESSYATGSEFVMDGGLVTDVPHKQF

SEQ ID NO: 5020 - protein, 446 aa, Mycobacterium paratuberculosis
MLRALADTVGSTHVVTDPDVLAARSVDHTGRYRGRASALVRPGSAEQLAEVLRVCRDAGAHVTVQGGRTSLVAGTVPEHDDVLLSTERLHRIADVDTVERRIEVGAGATLAAVQQAASAANLVFGVDLAARDSATVGGMASTNAGGLHTVRYGNMGEQVLGIQVALPDGALLRRRSRVRRDNTGYDLPALFVGAEGTLGVITELDLRLHPTPTHTVTAICGFADLDAVVAAGRTFRDVDGIAALELIDGRVAALTREHRGVPAPVDADWLLLVELAADHDQTERLAGLLDDAPLSGEPAVGVDAVARQRLWQVREALAEVLGVYGPPLKVDVSLPLSSISEFERAAIDLVHTHAPDALPVLFGHIGEGNLHLNVLHCAADREHALYEPMMDLIAASGGNVSSEHGVGSRKRPYLGMSREPADIAAMRTVKAALDPTGYLNAAVLFD

SEQ ID NO: 5021 - protein, 183 aa, Mycobacterium paratuberculosis
MSHPVRATAIADTDTSTRQRILAATAEVLGRNGKTKLSLSDVATQAGVSRPTLYRWFASKEELLSAFSAYERQIFESGLVKATAGLKGVDKLDAVLRFIVDYQHSYSGVRMVDVEPEHTIAQFSWVIPQMREGLQRHLPGPNAAVKAATVIRIAISHYIVRSDDADQFLAQLRHAVGIKAPTD

SEQ ID NO: 5022 - protein, 274 aa, Mycobacterium paratuberculosis
LTMTDAYYELIDSNASGERFRATDLARGTWSATIQHGGPVSALLTRALERCEQRDDTRLSRVVIDLLGGVPVEGDLWVRAEVQRPGKQIELLGAQMLAPGPDGAPRPVARASGWRLQHQDTGSLAHAAAPLPRPRAEAYDRNLKARDWDRNYVHSLQWLWLTEPLSEGPGESWISPTVDLVKGESMTRLQRLFAVADCANGIGSKLDITKWTFLNTDLAVHVFRVPDGDWIGIRAETSYGPDGIGTTIGTLFDEQGAVGAIQQSVLVRRRPGRA

SEQ ID NO: 5023 - protein, 290 aa, Mycobacterium paratuberculosis
MTLCRCFVKRKVCRRHERMIPEPLVNGFCFGEGPRWFEGLLWFSDMLGEAVHTTTMGGALTTLPLPGHCPSGLGFRPDGSLLIASTRDRRVLRYDGETVVTVAELADIAPADLGDMVVDRAGRAYIGCQAFTGGAIIRLDPDDRATVVADDLDFPNGMAITPDGATLIVAESTGRRLSAFAIDDDGALSGRRVFADGLDGPPDGIALDADGGVWAAMTLAHQFERIVAGGAVSDRIDIGDRVAIACALGGPQRRTLFLLSSTDAYPQRLVGTRLSRLDAVTVTTPGAGLP

SEQ ID NO: 5024 - protein, 157 aa, Mycobacterium paratuberculosis
LGIVTTSSETAFTQSAETVYDFVTNPQNWTKTYPGSAHIGKRPELPLRVGDTWEEAGPDGDRIFSWQLAAAVRPSLFVFTSIGRLGHDRDGNGGLPGRITVCYRFTRPGHDITLFSRTMTIEADKDAPLPDQLFVQANPARIDAYHEAVARELAALD

SEQ ID NO: 5025 - protein, 301 aa, Mycobacterium paratuberculosis
VESELSKVSQESTDWTVQGLLDLFEVRPDGQDRFTADTAGDIGAGGDERQVVEGTQVLAQAIVAVAKRFADKSVRSAHAVFSRAVAVGPPIELVLDVVAEGRSTATAVVAVHQNGRRCLSITVLADVPTGDVIRHQLPRPDVAGPADANPSPMPMVGRELRLVDVVDVNSPDEVGPPELYAWLHYDPIPTRDDLAKALLAYFTGHLGISTTMRAHPGIGTAQAHLTVSTAPMSISVAFHEPVRWDGWLLYSHESTQVGAGMSYVRGTVHTEQGELLASFAQEALIRPLRTSDTAIDSRARF

SEQ ID NO: 5026 - protein, 140 aa, Mycobacterium paratuberculosis
MHSHPYNRELVSGDGIAKVAAATEAAGIHGFGFTDHPAPSQRWLEAGGHDALDPFVALGFAAATTSTLRLIPNIVVLPYRNPFVVAKSGATLDLLLRRPLHPRRRRGLPQARVRGAGRQLRRARRAVRGGPAGDPRRVDR

SEQ ID NO: 5027 - protein, 166 aa, Mycobacterium paratuberculosis
VIRAVWTGDDISFEGRHFSARGITAHPRPVSSPHPPIWIGGNTAAARQRVADYGDGWCPFPAPPQLARTAGTAVIDSVAKLADGIADLRRRCDAAQRDWSTIDITFTNFEGGSPADDEFNADAYLDGLDKLAKLGVTWVSVHLPGDSMAHALETLDRFRTLVVDAA

SEQ ID NO: 5028 - protein, 391 aa, Mycobacterium paratuberculosis
MDFSRVELSAQDAAFQQSTRAFLAEHVTEEVRRRDRETGENFSEPVHVALGEAGYLESDWKLESEGGFDPVRRRIFQLEIGRAHTPWFHWGTTAVVARLVKQFGAPELADAILPGVLSGKIRLCLGYTEPEGGSDVATCKTRAVRDGSGWIINGSKMFTSNAQNAEYVFLLTNTDPQRPKHKNLTMFLVPLDSPGIEIQGIRTVDGDRTNIVYYSDVRVDDLYRIGEVNGGWTVMRFALDAEHGLTDPQDHGLQNISMLSEHGHLMAEAADRVAAILARPDAAGRRPIDDESVKYRLGRGMARIEAAMSTPGMYGRVALIQTMREVSQELMDLLGTASALPTDTPGSPDDGAIEFIFRHAVPAGIYGGTMEVFRNMIAQHELGLGRPSYGR

SEQ ID NO: 5029 - protein, 236 aa, Mycobacterium paratuberculosis
LRAMGGRPMSLVAGRGPLSSDPAGRFSPPIPAEVVYVEPHPRRVQAVKDGRSVIDTERALMVHRRGRPLSYVFPADEVAGLPGEPEPEAPGFVHVPWDAVDTWWEEGRKLVHYPPNPYHRVDCRGTRRRLRVRVGGTTLVDTDHTTIVFETALPPRLYVDPAHVRTDLLRRSETTSYCNYKGFATYWSLVDGDRVVDDVGWCYPDPPPESLPIKGFLSFDETRVELLAELPVSARS

SEQ ID NO: 5030 - protein, 392 aa, Mycobacterium paratuberculosis
MAGPVEGVTVVELGVWVAGPAAGGILADWGADVIKIEPPTGDPARMFGRMLGCDLGLNPPFEMDNRSKRSVVLDLSSEPDRRAAFELLSGADVFLTNVRPGALQRLGLDFASVSAANPRLVYGLITGYGASGPDADRAAFDVAAFWSRAGVAHLLTRPGDTPPFQRGGMGDHSAGMTMAAAVCAALLARERTGAGQLVTTSLYRQGAYTVSFDLNTYLMSGQPIAIGQRESMGNPCMNNYAASDGRRFWIVGLEPERHWPALCRAVGRPEWRDDPRFADARARAANSVALIAALDEIFATRPLDEWAQIFANEPDFFWSPVNSLEDVVADEQFHAAGGIVYVPDGADDQAAVPMVATPADFHGTPWAPRSAAPELGQHTAEVLAELKARRGS

SEQ ID NO: 5031 - protein, 149 aa, Mycobacterium paratuberculosis
VQSAGGWLYDRAMAGWEVTVLLPHGCNTRSLRILGVRAADLDSGLAGLGQGAAGLAVSADAFTADARVRDTVLESLHNRLTAVALWGDGWPLGVSRATTRTQHLLSGAARRFKGYALAAEGISDGGIAPAESLLCDVCSAADSELVRLD

SEQ ID NO: 5032 - protein, 234 aa, Mycobacterium paratuberculosis
MKKYYRHTLLYLHETISLGSGRSDRFTEVFTDTYRPMMDQLGARLFAIWESTPYNGHWPQVTIIWEVDGFADYARIGAAQARGGSHEAAAGKWSAFLADIGASGEGRIMYPGPSNKTLAQLREANFTAPLVIQEIMQTKPGRQDDYIRELERLYVPWSERTGKRWLGSFTTTFRYNEVIHYWALDGGWDCFANHYPSWKESPPAEIVTWMSVAPALRDGWEDSILQALPPSPLQ

SEQ ID NO: 5033 - protein, 403 aa, Mycobacterium paratuberculosis
VDFAYDPFDAEVMANPLPYYRILRDHHPVYYMPQWDTFALSRFDDIWRVLEVNNGTFVASEGTLPPASVLAQHNDGPVDDPPLHPLPFHAMFDADLYGEIRRTHSRPFRPRAVTDLEGRIRTLANERLDELLARGSFDLTQEYGGVVVATIVCELLGIPTDLAPQVLAAVNAGSLAEPGVGVDTGQARPNYFEFLLPAVQRRRADPSGPPLEVVDGLLGYQLPDGSALDDLEVATQMLCIFIGGTETVPKIVAHGLWELSRHPDQLAAVRADPQHNIPVAREEMIRYCAPAQWFARTVRKPFDIHGQTPNPGQRVITLLASANRDEREYPDPDDFVWDRPIRRSLAFGRGQHFCIGYHLARLEVAVLLQEWLRRVPDYAIRADAATRLPSSFQWGWNKIPVEV

SEQ ID NO: 5034 - protein, 322 aa, Mycobacterium paratuberculosis
VWCYRIVAPYRFEPTTIDDKTPECLADGQVLLRFSAAGVCGSDLPAFRGARGRLPGDDGRSGPEKDGFPIHEIAGEVIASRHPAHRPGDRVVGWASGFDGLMERVVSDGDGLAPYDPALSPAQAVELQPLACVLYACEQLGELAGKHVAIIGQGSIGLLFSYVAKAAGARRVTGVDPIDRRDVARAFGVDDPVRATSDRWVSQLDPADRADVVIETVGHQVATLAHAIDAAAPGGTVFYFGVADDDTYPISMRTMLRNNLTLKSGVTLDRRRMLELAGKFAAEHPWLLGAYLTHTFGVDEVQDAFELACRPVADRIKIAIAG

SEQ ID NO: 5035 - protein, 193 aa, Mycobacterium paratuberculosis
VLRRIEHLPIGTVVRLPNADAAPIGRVADAGADAVIIAMIESPDQAAAAVAATRYPPAGVRSFGPLRASLGHDPAAHESRVSVFAMIETAAALSGITQICAVDGLTGIYVGPADLAISLGAGVIGATRQPEVLDAIVHIHKAATKAGLVTGIHAGDGSTGHAMAQLGFDMITLAAEAQALRRGAAEHLREATQ

SEQ ID NO: 5036 - protein, 248 aa, Mycobacterium paratuberculosis
MTGGSAQPPRVALVTGAAGGQGRAIAERLRGNGYAVAACDRRIDELAATVAASGDDRLIAVELDVTSEQQWRSAVERVVDRFGALSALVNCAGVLHRTPLPQETADAFENAWRVNCFGAFLGMRAALERLRGTPGASIVNICSTGAIHPFPQHCAYGSSKWALRGLTQTAAAELAPAGIRVNAVFPGPIATPMLDQATQTRLAAAASFGRIGQPREVADAVAFLVSAEASFITGAELIVDGGQCLQIR

SEQ ID NO: 5037 - protein, 531 aa, Mycobacterium paratuberculosis
GRRRGGVPGVRRGVVHHRRRTHRRWRAMPADPMSELSIGIIGAGPGGLALGILLSQAGFGDFTIFDREDGVGGTWRINTYPGLACDVKSHLYSYSFDLNAHWSRLWSGQPEILDYFQRCADKYGLGPHLRLGTEIRSAHWDADTQRWRLTTASGHRHHFDVVVSAVGLFTRPLLPELVEEEPFTGTVMHSARWDHSIPLHGKRIAVLGTGSTASQLIPELAKVAERVYSVQRSPTWILPKPDRPYTQWERWAFAHLPLAKKLYRTRLWLRSESNISVIEHGSEKTGQFTNIALGLLEASVPDEELRRKLTPDHPMGCKRLVFSSDYLPALTRPNVEVLTSPARSLRRRSLVTEDGTEREVDLVVCATGYAAADYLGELDVTGERGVTLREVWRDGAYAYLGMAVPGFPNFFMLYGPNTNVGSNSVIFVLEAQARYIVRALKYLRRHRRRYIAVRPAALADFVAKIDRWMVGTVWTTQCSNYFRAPNGRVVTQWPRSARAFWSMTRRFRPADYRFQAPAMRVPAPASEADAR

SEQ ID NO: 5038 - protein, 305 aa, Mycobacterium paratuberculosis
VTALDGAERLDPALRAVATTRTDFSPAAIELTRAPFNERRRLAAAQTDTAGVRIVDDDANGVGVRIYRGGPEPAPAVIYCHAGGFALGNLDTDHRQCVELARRGRCTVVSVDYRLAPEHPYPAALQDAGTVLRWVHAEAAALGVDPARLAVAGSSAGAALAACLAHPDGSLPAVVFQLLHQPVLDDRATGSKARFRTSPAFDGEAAELMWRYYLGPTVGSAAAVPARRPELAGLPPALITCAEIDPFRDEAIDYARRLLDAGVCTELHVFARACHGFDSLLPDWPGSQRLFALQGEVLSAALHRD

SEQ ID NO: 5039 - protein, 363 aa, Mycobacterium paratuberculosis
VLQRIGAPRPYARSRPITITDVELAPPGRDEVLVRIEAAGICHSDLSVVDGNRVRPVPMLLGHEAAGIVERVGPGVADLAVGARVVLVFLPRCGRCAACATEGLTPCEPGSAANGAGTLLGGDIRLSRAGRPVYHHLGVSGFATHAVVNRASAVEVPPDVPAEVAALLGCAVLTGGGAVFNVGRPAPGQTVAVVGLGGVGMAALLTALTYDGVPVVAVDQLPEKLAAARRLGAHQAYTPQQAVEARVKAAVVIEAVGHPAALQTAIDLTAPGGRTITVGLPPPDARITLSPLGFVAEGRSLIGSYLGSAVPSRDIPRFVELWRAGRLPVESLVSSTIRLEDINEAMDHLADGTAVRQLIRFDA

SEQ ID NO: 5040 - protein, 161 aa, Mycobacterium paratuberculosis
MASAPVVPPAPEGLTSNDFPVLWPVGTRWADNDMFGHLNNAVYYQLFDTAINAWINTSTGLDPLTTPALGIVAESGCRYLSELHFPEGLQVGLAVTRLGRSSVTYRLGVFRSAAPGSAEPITALGHWVHVYVDRDTRKPVPIPDPIRTLLAGAAVGDAAPK

SEQ ID NO: 5041 - protein, 153 aa, Mycobacterium paratuberculosis
VPRYASRMPVLSKTVEVNTDAAAIMAIVADFERYPEWSDGVTGCWVLARYDDGRPSQLRLDAAYQGFEGVYIQAVYYPGPNQIQTVMQQGELFKKQEQLFSVVEMGASSLLTVDIDVEPSMPVPAPMVKSMLNNVLDHLADNLKQRAEQLAAN

SEQ ID NO: 5042 - protein, 271 aa, Mycobacterium paratuberculosis
VLCGSHYGVDGLLTSPRRHRSKRKPRPAKPLKALASPVNAPMSMQPRSRRRPLRRAQLSDEVAGHLRAAIMSGALRPGTFIRLDETAAELGVSVTPVREALLKLRGEGMVQLEPHRGHVVLPLTRQDIEDIFWLQATIAKELAAAATDHITDTEIDELDRINDALAAAVGSGDAETIAGLEFGFHRVFNQASGRIKLAWFLLNAARYMPVLVYAADPQWGRAAVDNHRQLIAALRRRDTAAVIEHTVWQFTDAAARLTEMRDRTGTPSNRG

SEQ ID NO: 5043 - protein, 74 aa, Mycobacterium paratuberculosis
LTAQLAHHPTQANEQPYLSRRQNWVNQLERHALMQPNATALRFLGKGLTWGELHGRVRALADALSRRGSASATG

SEQ ID NO: 5044 - protein, 454 aa, Mycobacterium paratuberculosis
VMVLMLNRPEFMESVLAINMLGAIAVPLNFRLTAAEIAFLVQDCQARVVITEAVLAPVATGVRDIESLLDTVVVAGGSSDDTVLGYEDLIDETGAAHQPVDIPNDAAALIMYTSGTTGRPKGAVLTHTNLTGQTMTGLYTNGADINNDVGFIGVPFFHIAGIGNMLTGLLLGIPTVIYPLGAFEPGQLLDVLAAEKVTGIFLVPAQWQAVCAEQRARPRDLKLRVISWGAAPAPDALLREMSAMFPGTQILAAFGQTEMSPVTCMLLGEDAIRKRGSVGKVIPTVAARVVDENMNDVPVGEVGEIVYRAPTLMSGYWNNPEATAEAFAGGWFHSGDLVRMDEDGYVWVVDRKKDMIISGGENIYCAEVENVLASHPDIVEVAVIGRAHEKWGEVPIAVAAVANDNLALEDLDEFLTERLARYKHPKALEIVDALPRNPAGKVLKTELRIRYGGG

SEQ ID NO: 5045 - protein, 271 aa, Mycobacterium paratuberculosis
VTSTSTSRRGPYLVGYLRDQLETPLTLVGGFFRMCVLTGKALFRWPFQWREFVLQCWFIMRVAFLPTIMVSIPLTVLLIFTLNVLLAQFGAADLSGAGAAIGAVTQLGPLTTVLVVAGAGSTAICADLGARTIREEIDAMEVLGIDPIHRLVVPRVIAATLVATLLNGLVITVGLVGGYLFGVYLQNVSGGAYLATLTTITGLPEVVIATVKAAVFGLIAGLVGCFRGLTVRGGSKGLGTAVNETVVLCVVALYAVNVVLTTIGVRFGTGH

SEQ ID NO: 5046 - protein, 251 aa, Mycobacterium paratuberculosis
VGVALAHIPHALSHYRKETLRLIAQIGMGTGAMAVIGGTVAIVGFVTLSGSSLVAIQGFASLGNIGVEAFTGFFAALINVRIAAPVVTGIAMAATVGAGATAELGAMRISEEIDALEVMGIKSISFLATTRIMAGLVVIIPLYALAMIMSFLSPQITTTVLYGQSNGTYEHYFRTFLRPDDVFWSFLEAIIITAVVMITHCFYGYNAGGGPVGVGEAVGRSMRFSLVSVQVVVLAAALALYGVNPNFALTV

SEQ ID NO: 5047 - protein, 434 aa, Mycobacterium paratuberculosis
MARPVQTNAPRTPPYKLAGLAILVVGALALALIYGQFRGNFTPKTSLTMLASRAGLVMDPGSKVTYNGVEIGRVGTISETVRDGKPAAKFTLEVYPRYLKLIPSNVNADIKATTVFGGKYVSLTTPANPSPQKITPHTIIDARSVTTEINTLFQTITSIAEKVDPVKLNLTLSAAAQSLSGLGEKFGQSVVNANALLDDVNPRMPQARKDIQGLAALGDTYADASPDLFDFLNNAVITSRTINAQQKDLDQALLSAAGFGNTGADLFNKGGPYLARGAHDLVPTAQLLDTYSPEIYCLMRNEHDALPATGAAEGGFNGYSLNMNTEALSGLGLIANPVSAVPVIASMVGGIVGVVGGAPNPYIYPENLPRVNARGGPGGAPGCWQPITHDLWPAPELVIDSGNSLAPYNHLDTGSPYAIEYVWGRQVGDNTINP

SEQ ID NO: 5048 - protein, 346 aa, Mycobacterium paratuberculosis
MKITGTLVRLSIFSVVLLIFTVMIIVVFGQMRFDRTNGYSAEFSNISGLRAGQFVRASGVEVGKVSSVQLVDGGKRARVEFNVDRSVPLYQSTTAQIRYLDLIGNRYLELKRGQGEGADKVLPPGGFIPLSRTQPALDLDALIGGFKPLFRALDPQKVNTIATALVTVFQGQGGTINDILDQTAQLTSQLGERDQAIGEVIKNLNTVLDTTVRHRQQFDQTINNLEVLITGLKDHGDQLAGGTAHISNAAGTVADLLAEDRSLLHKTLNYLDAVQQPLIDQQDQLQDYLKKVPTALNMIGRAIGSYGDFVNFYACDITLKINGLQAGGPVRTVRLFQQPTGRCTPQ

SEQ ID NO: 5049 - protein, 518 aa, Mycobacterium paratuberculosis
MRTLEPPNRVRIGLMGIVVTVLVIGVGQSFTSVPMLFAKPSYYGQFTDSGGINTGDKVRIAGMDVGKVEGLKIDGDHIVVKFSIGTNTIGTESRLAIKTDTILGKKILDVEARGSQQLRPGSTLPLGQSTTPYQIYDAFFDVTKAAQGWDIETVKQSLHVLSQTIDQTYPHLSSALDGVAKFSDTIGKRDEQVKHLLAQANQVASVLGDRSDQIDRLLVNTKTLLAAFNERGQAINALLGNIAAFSEQVKGLINDNPNLNHVLEQLRTVSDILVQRKDDLANGLTEVGKFLPSLNEAIASGPFFKVVLHNLALYQISQPWVDAAFKKRGIDPEDFWRSAGLPAYRFPDPNGTRFPNGAPPPAPPVLEGTPDHPGPAVPPGSPCSYTPAADGLPRPDNPLPCAGAVTGPFGGPGFPAPVDVMTSPPNPAGLPPTPGIPIAGRPGDAPPDVPGTPVPLPTQAPPGARTENLAPAGPVPPPSTFAPGAAAGSAGTPRAGQPVAGAVHQPRRDRRQRRSGGR

SEQ ID NO: 5050 - protein, 537 aa, Mycobacterium paratuberculosis
LSTIFDIRNIRLPKLSRTSVILGSLVIVLALVVGYVGWRLYEKLTNNTVVAYFPAANALYPGDKVQIMGLRVGAIDKIEPSGDKMKVTFHYQNKYRVPANASAVILNPTLVASRAIQLEPPYKGGPVLADNAVIPEERTQVPVEWDQLRNSITNIISKLGPTAEQPKGPFGEVIESFADGLAGKGKQFNTTLTNLSRALTALNEGRGDFFAVVRSLALFVNALHQDDQQFVALNQNLADFTTRLAHSDGDLANAIEQFDSLLTTVRPWLDKNRGVLTYDVKNLETATNALLQPDPLNGLETALHVLPTAAANINQIYHPSHGSVVAIPSITNFANPMQFICSAIQAGSRLGYQESAELCAQYLAPILDAIKFNYPPFGLNLFSTAETLPKEVAYSEPRLQPPNGYKDTTVPGIWVPDTPTSHRNTQPGWIVAPGMQGQQVGPITAGLMTPDSLEELMGGPNIAPVQSNLQTPPGPPNAYDENPILPPMGLNAPVPIPPPPPGPGVAPGPVAPTPAPVSAPAPNAGGPAAPADFGGGQ

SEQ ID NO: 5051 - protein, 386 aa, Mycobacterium paratuberculosis
MGALRVIRRRSWQGLTLLVAAMVLTSCGWKGISNVSIPGGPGSGPNSYNIYVQVPDTLAINGNSKVMVADVFVGSIKAIQLKNWIATLTLGINKNVKLPKNATAKIGQTSLLGSQHVELAAPPNPSPELLKDGDTIPLKNSSSYPTTEQTLASLSLILRGGGIPNLEVLQNEVYNIFNGRGEAIRALLGKLDTFTNQLNQQRDDITHAIDSTNRLLTYVGGRADVVDRLLTDVPPLIKHFADTKQLLINAVDSVGRLSQAADQYLSEARGPLHTDLQALQCPLKELGKASPYLIGALKLILTQPFDIDTVPKIFRGDYINISLTLDLTYSAVDNAFLTGTGLSGALRALEQSYGRDPETMIPDVRYTPNPNDAPGGPLVERGDRNC

SEQ ID NO: 5052 - protein, 212 aa, Mycobacterium paratuberculosis
LLTPFVRRQLVAFGILTVISLLVLGIYYLQIPSLVGIGRYTLKAELPASGGLYPTANVTYRGITIGKVTDVEPTEHGAEATMSIDSHYKIPIDAVANVHSVSAVGEQYLDLVSSGNPGKYLSSGQTITKGTVPAEIGPALDTANRGLAVLPKEKIGQLLDETAQSVGGLGPNLQRLVDATQAIVGDFKNQITDVNDIIEHSGPGDRQPGQIR

SEQ ID NO: 5053 - protein, 412 aa, Mycobacterium paratuberculosis
VSSTWTWCRAETPASTCRPGRPSPRARCRPRSGRPWTPRTAGWRCCPRRRSASCSTRRRSPSAGWAPTCSGWSTPPRPSSATSRTRSLTSTTSSSTPGRVIDSQVKSGDAIERWARNLNRLGAQSAQEDSHLKSLLRQAAPTADQVNDVFNDVRESLPQTLANLEVVIDLLKRYHTGVEQVLVFLPQGASIAQTVAAPFPNMAALDLALSINQPPPCLTGFIPASEWRSPADTSLQPLPTGTYCKIPMDTPANSVRGSRNIPCTDIPGKRAATPRECRDPKPYVPAGTNPWYGDPNQILTCPAPAARCDQPVKPGMVIPAPSVDNGLNPAPSDRVAGTPPPVSDPLSRPGSGTVQCNGQQPNPCVYKPSGPPTAVYSPQSGELVGPDGVKYSVENSTRTGDDGWKEMLAPAG

SEQ ID NO: 5054 - protein, 213 aa, Mycobacterium paratuberculosis
LSPQDKDEDSTAPASTDEQTGSQGAPGVAGESAPDAADDAAVAAVPRGPSRLGRGWLAAIAAVLVLCAAGIGAGGYLALRYHHESQVIARNNAAALKAAVDCVEATQAPDTNAMTASEQKIIDCGTDAYRSQALLYTSMLVQAYQSANIHVQVSDVRAAVERNNPDGSIDILVALRVKVASDQSQNESGYRLRVKMALAEGQYKISKLDQVTK

SEQ ID NO: 5055 - protein, 323 aa, Mycobacterium paratuberculosis
VTVLVEQTATTGTPEPVREALAPWHSRVGAFAIDVAPGAAVIATMALVSFTVPARGVWWWVGVCMLGVVTLLALVNRLLLPVITGWSLGRALAGIAVTRRTDAAPGPWRLLLRDLAHLLDTASIVGWLWPLWDSRRRTFADMLAGTEVRRLAPEQVPPHISRWAAAAVLGAAAVCLGGAAMSYGVVYSADRAADQTRAQIATQGPKIVAQMLTYDPKSLHDDFARAQSLATDRYRRQLQTQQDVVQKGNPVINEYWVTNSSIESASRDRATMLLFMQGRRGAAPEVRYISATVRVSFAKVGENTWRVDDLTVLTKPKPPGGAK

SEQ ID NO: 5056 - protein, 184 aa, Mycobacterium paratuberculosis
MSPRRKFAPGERPLLVARPVRPPRGWLLPLAGTAAALLMVTAVTLCALMLVSHESRERAASKDREVLSYVSGFMTQFTSIDPFHANDYVNRILAQATGDFAKQYEKNANEILLQVARAEPATGTVLDAGLERWNDDGSANVMVATAITTKSPDEKQVLENTNRWAATATQEGNQWKISSLQQVI

SEQ ID NO: 5057 - protein, 252 aa, Mycobacterium paratuberculosis
VEDQQPPAGDLTAEENPAAADQNEATVAAAGDDRENGDAATESEAAETSDAQPADGAEDTQSAETVATAGAAPAAGRRTKRLAGKAWAVAAMVAALLFVGSAGFAGAMVQPYLADRAVAATKLKVARTAANAITTLWTYTPENMDTLADRASAYLSGDFEAQYRKFVDAIVAPNKQAKITNHTDVTGAAVESLDDTNAVVIVYTNTTSTSPLTKNVPSLKYLSYRLFMKRAKSRWLVTRMTTITSLDLTPKV

SEQ ID NO: 5058 - protein, 216 aa, Mycobacterium paratuberculosis
LLTFATGLADAISILVLGHVFVANMTGNVIFLGFWLAPRTSIDLTAVVVALPTFACTTILSGRLARHFGERVRAWISTVLATEIVLLVGLSVLAGSGILGYQQDSKLLMIAILAVTFGLQHSSARQFGIQELSTTVLTSTIVSLGLDSRLAGGTGERQRLRIGVVATMCAGAFLGATMSRYVVAPVFVVAAAVIAASLLIFRFGPPAAKPAAAEAN

SEQ ID NO: 5059 - protein, 366 aa, Mycobacterium paratuberculosis
MAERAIVLTRRASFRRLAACCTALSACLTLAVTSGQPLARAADGRDLLANAISSTRGSYLVYNFGPGHPAPMLNAGGSWYEMNNGGHLMIIKNAAGRLSPHLLVDTHQGDQARCENNPGARTAEGLWQASELYAPLQAWQRMGQPTIAINANFFDVRPQKGGSWRQTGCSSPLGAFVDNTNGRGRANQAVTGTVAYPGKQGLSGGGESWSALTTMILPSGGAPYVVWPKTKSDYDAATPVVADLLNKNEKFVAVSGIGLLAPGNTGQLHDGGPSAARTAIGYARQKDEMYIFEGGSYTPDNMQDLFRGLGSDNAVLLDGGGSSAIVLRRDTGGMWAGAGSPRGSCDTRQVLCDSHERALPSWLAFN

SEQ ID NO: 5060 - protein, 474 aa, Mycobacterium paratuberculosis
MARSHPQHAAPNPNRNIKAVRTVRFWAAPLVITLALMSALCALYLGGILNPTTNLRHFPIAVVNEDAGPGGAQIVDRLATGLDRNKFDIRVLSRDEAKHQLDTGRVYGSLLIPPSFSSKLRDFATSAVSPARPDKPSITVSTNPRAGTLGASIAGQTLNSAMGTANGIAAQRVMAEVTAQTGGAPLPGATQAGLSSPIEIQSVVYNPLPNGTGNGLSAFYYALLLLLAGFTGSIVVSTLVDALLGYVPAEFGPVYRFAEQVRISRFQTLLLKWAMMLLLGLLTSAVYLAIADGLGMPIDLSWELWAYGVFAIAAVGITSSSLLSVLGTAGMLVSMLVFVIFGLPSAGATVPLEATPPLFRWLAEFEPMHQVFLGTRSLLYFGGRGDAGLSQALTMTSAGLVIGLLLGGIVTHVYDRKGFHRIPGAVEFAIAQDHQAQHQARRGKSTQQPDSPAEPETPTEPESPDEPESPSAQT

SEQ ID NO: 5061 - protein, 241 aa, Mycobacterium paratuberculosis
MSAGFEIRRAATRAVTTTPWLTSRHSFSFGDHYDPDNTHFGLLLVNNDDIVSPGTGFDTHPHRDMEIVTWVLAGALAHQDSTGNRGVVYPGLAQRMSAGRGILHSERNDSPSVPVHFVQMWVIPDEAGIDPSYQQHEIDDTALGGGMVTIASGIRGHDAAIGLHNRNAALHGARLPAAAAVDLPAAPYLHVFLARGRADVEGVGELHPGDAVRFTDTDGRRVTGLEPSELLLWEMHARLGG

SEQ ID NO: 5062 - protein, 296 aa, Mycobacterium paratuberculosis
VAESIGETPRRSGVKSPPTARVMDVLAAVADSPGGRTSAELAKGCAISSSTCALVLAELERRAWVTRRDDRRYVLGSGLFGLVHGLREQFPLLDRGRDALRLLRERLGAGCSMSKIGARHLTTVDSVGHGTDGEHAVGQRFPIDPPFGLVAMAWRDDDAVQAWLRRVTPRLTRTEIAQHQRVLADIRARGYGAWRFDDTHRSLHNRLAEALASLEPTAQVARRLTTLMTMVTLRSITDVLETELPTTEFVVLPIFGHDGQPEYQIEIHLGHSAGLTLPELDDALEQARRLLTAPVR

SEQ ID NO: 5063 - protein, 377 aa, Mycobacterium paratuberculosis
VYKVGVWGPGSMGVIALRGVIDHPQLELVDLVVHSDAKAGRDAGELCGVAPVGVVATQDPAAMLAGDADVVVYAAGANLRPLEAVEDMVSLLRAGKNVVSCSVVPLVFPDAVDSAFSEPLRAAALEGQVSFFTTGIDSGFANDVLPLVLTGVSRVIESVRVTEMFNYATYPDASAVYEILGFGQPPDYPAFAAQPGIFTFGWGPVLHQLAAGLGVEIDHIEESNERIPAPESFDTPTGHIAAGTIAAMRSTLTGYVGEKPTFVLDHVTRMRDDLAPDWPQPRIAITPKDLGYGLASGRGLYRVEIEGSPSMRCEFEMAEDHDHDLGARIAGSSRMVNAIPAVCAAPPGLLSALDLPLITGAGLVRPVLGPPPDSRLF

SEQ ID NO: 5064 - protein, 467 aa, Mycobacterium paratuberculosis
MTSSTVGVTPVPGNPRLLLSAYDLATVGYVAEEFFVSATASRYGPAGELGADGCWEVIRCGAADFTTRVVVLTPADPARFNGTVLVEWLNVSGGIDAAAVWMMAHREILRAGYAYVAVSAQRVGVEGGESLLGADMSLKSQDPQRYAALHHPGDAFSYDIFTQIGGLLTTGGHTAMLRGLPARHVIALGESQSAMFLTTYINAVDPLAGVFDGFLVHSRFGPAAPLDGTSIFTESTEPQAVTFRPELRVPVLTLITETDVFGGPREGYYFARQPDNPRLRVWEIAGAAHADNYTIQVAFIDSGSAPLEDIVSGYAPTNMLMGQQLPHYINFGPQHHYVVQAALAALNTWVTAGQPAPGAEPLQVREGPAPQPVLDGNGLARGGLRTPWVDVPIARTSGLGGQESVMSAIFGSGEPFDAATLERLYPGGRTEYLERFTVALDAAIGAGFILPADRAEILRLAAATFPG

SEQ ID NO: 5065 - protein, 366 aa, Mycobacterium paratuberculosis
LRVPHHYRQRNGCGSAPRLQTLRTLMRVSLLAQTPEGDSVVGADFTAHAEPYRRELLAHCYRMTGSLHDAEDLVQETLLRAWKAYDRFEGKSSVRTWLHRIATNTCLSALEGRQRRPLPVGLGAPSADPTAELVERREVPWLEPLPALTDDPADPSVIVGSRESVRLAFVAALQYLSPRQRAVLLLRDVLGWRAAEVAEAIGTTTAAVNSLLQRARAQLDAVGPSADDQLAQPDSAETQDLLARYIAAFESYDIDRLVELFTAEAIWEMPPYTGWYQGARTIVTLIHQQCPAEGAGDMRLLPLIANGQPAAAMYMRAGDVHLPFQLHVLDVRGDRVSHVVAFLDDSLFAKFGLPAALGPRQEGVRA

SEQ ID NO: 5066 - protein, 277 aa, Mycobacterium paratuberculosis
VNRTERSFDGVGGVRIVYDVWTPEVAPRAVLVLSHGFGEHARRYDHVARRFGAAGLVTYALDHRGHGRSGGKRVLVRDIHEYTTDFDTLVGIATREHHGLKCIVVGHSMGGGIVFAYGVERPDNYDLMVLSGPAVAAQDQVSPLLALAAKVLGVIVPGLPAQELDADAVSRDPEVVAAYRNDPLVYHGKVPAGVGRALLQVGETMPQRAPALTAPLLVVHGSDDRLIPVAGSRRLVECVGSADVELKVYPGLYHEVFNEPEREQVLDDVVGWITARL

SEQ ID NO: 5067 - protein, 249 aa, Mycobacterium paratuberculosis
VSDDKMLARIAALLRQAEGTDNSHEADAFMSAAQRLATAASIDLAVARSHSAQRSAAQAPTQRTITIGAAGSKGLRTYVQLFVLIAAANDVRCDVASNSTFVYAYGFAEDIDASHALYASLVVQMVRASDAYLASGAHRPTPTITARLNFQLAFGARVGQRLAEARDQARQEATKDRRRAPGTAIALRDKEIELVDFYRSASKARGTWQASRASAGYSSAARRAGDRAGRRARLGSSPELPGARSALSG

SEQ ID NO: 5068 - protein, 170 aa, Mycobacterium paratuberculosis
VSPGDSPPRDSQRSRVYAAEEFVRTLFDRAAEHGSPAVEFFGTRLTLPPEGRFGSVPSVQRYVDQVLALPAVRQRWPDVPPLRVRPRRAATAAHYENRDGAGVIAVPDRDTAEWALRELVVLHEVAHHLCRAGPPHGPEFVATICELTELVMGPEVGHVLRVVYAKEGVR

SEQ ID NO: 5069 - protein, 691 aa, Mycobacterium paratuberculosis
MTDDERFSLLVAVMGAGDMWPVRDERIPADVPMSAGYVPGVPRLGVPPLLMSDAGLGVTNPGYRPGDTATALPAGMALAATFDPALARAAGELIGREARSRGFNVQLAGAMNLARDPRNGRNFEYLSEDPLLTAAMVAESVAGIQQQGVISTVKHYSLNCNETNRHFLDAVIDPDAHRESDLLAFELAIERAHPGAVMTAYNKVNGVYAAANSVLLNDVLKDAWAYRGWVMSDWGATPGWECALGGLDQECGAQIDALLWQAESFGAPLRDAYADGRLPKDRLSDMVRRILRSIFAVGVDRSDREPAPDLNAHNDIALRIARQGIVLLTNRGLLPLRPDSPARIAVIGGYAQLGVPAGFGSSTVVPAGGYAAVVPIGGTGLEAGLRNLYLLPSSPLQELRRLLPENTIDFDPGISPAEAVAAAQRADIAIVFAVRAEGEGFDLADLSLPSGQDELIGAVAAANPNTVVVLQTGNPVTMAWLGAVNAVVQAWYPGQAGATAIAEVLTGRVNPGGRLPITFPVDLHQTPRPQLPGAGLPWGTPSTIDYVEGADVGYRWFAAKGHVPMFAFGHGLSYTRFEHRDLVVRGGDTITAGFTVVNTGDRAGADVPQLYLTAMPGKPCLRLLGFERVELGPGESRHVTIDADPRLLAHYDGSIRSWRIAAGSHTVALGISATTLRSTATVELTARAFGR

SEQ ID NO: 5070 - protein, 51 aa, Mycobacterium paratuberculosis
VSHMATYESGTLLTCGHEGCGCRVRIEVPCHCSGAGEEYRCTCGDALTPVK

SEQ ID NO: 5071 - protein, 217 aa, Mycobacterium paratuberculosis
MTEKPTPKDVDAFLDSTVVGGDPSVIDALEASSAAGLPPIAVSVQQGKFLSLLATAMGARRILELGTLGGFSTIWLARGAGPQGRVVTLEYEPKHAEVARANLQRAGLADRVEVIVGAALDTLPSVTGPFDLVFIDADKENYPAYLDWAVRLARPGAVIVADNVIRQGQILKPEADAQARAVRQTLQAMGEHPRLDTAVIQTVGAKHWDGFAFAVVR

SEQ ID NO: 5072 - protein, 238 aa, Mycobacterium paratuberculosis
VLAFGENRGLVAHLRLAGAFVFVMVGTVAQARAAIAWGADGLIAQGREAGGHLVGTTAALDFLPHALAAAGGRPVFLAGGIATAADSRAALDAGADGVIAGTRFLLTHESDASRGYQQRVLQADNTIETNLFGLSWPLRHRVVPNAATRRWCGADGKARALPAALNAASRPLSALGYFDAGALLRLQSPRRPLFTPLAPVAGVPDSLLDSAALYAGETASRIGELTSARQAVADLTPR

SEQ ID NO: 5073 - protein, 94 aa, Mycobacterium paratuberculosis
VIKITPARRPPATKTGAGPAPQPALAKPVRRLRRNVAGHGHRRPVAARCSGRAGRDGRRAGRCAAGGRGRRGGWPGHAGHHHPRPARSVDPAGA

SEQ ID NO: 5074 - protein, 144 aa, Mycobacterium paratuberculosis
MSTVHSSIDHHPDLLALRARYERVAESMSAHFTFGLALLAGLYVAASPWIVGFSATASLATSDLIAGIAAAFLAYGFATTLDRAHGMTWTLPVLGAWVIVSTWILPGVVLTAGMTWSNVVAGALLTFLGLNATYFGMRTRASAG

SEQ ID NO: 5075 - protein, 575 aa, Mycobacterium paratuberculosis
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 5076 - protein, 96 aa, Mycobacterium paratuberculosis
MTNEHGYSQQKDNYAKRLRRIEGQVRGIARMIEEDKYCIDVLTQISAVNSALRSVALNLLDEHLGHCVTRAVAGGGDDADEKLAEASAAIARLVRS

SEQ ID NO: 5077 - protein, 414 aa, Mycobacterium paratuberculosis
MTVMTAETANAAARTWTPRIAAQLAILAAAAFTYVTAEILPVGALPAIARNLQVSLVLVGTLLSWYALVAALTTIPLVRWTAHLPRRRVLVASLTCLTASQLISALAPNFAVLAAGRVLCAITHGLLWSVIAPIATRLVPPSHAGRATMSIYVGTSLALVVGSPLTAALSLMWGWRLAVVCVTVAAAVVTVAARLMLPEMVLTEHQLAHVGPRSRHHRNGRLITVSLLAMVAVTGHFVSYTFIVEIIRNVVGVRGPTLAWVLAAYGLAGLLSVPLVARPLDHRPKSAVILCMTGLTAAFAVLTALAFGGPTGATTALIGTAAIVLWGAMATAVSPMMQSAAMRNGADDPDGASGLYVTAFQVGIMAGSLLGGLLYERSVILMLSASGVLMAVALVGIAANRRMLDVAPTSSRDS

SEQ ID NO: 5078 - protein, 345 aa, Mycobacterium paratuberculosis
MSGGMPMSGWTRGTLFAALNAAVVSVVGLALVLSAGPALADPDPAPADPGAVAAPPGPPAPPDPLARPPPPDPLAPPPPTAPPAPWLPPAAQPAAAPAAGQDPTPFTGTPPFGPPTFVPKTGSTVGVAQPIIINFPGRVDDAGAAISAVHVSSVPPVPGKFYWMTPTQLRWRPLSFWPAHTAVTVDAGGTVTNFQTGDTLVATADDATHQLTVTRNGTVEKTFPMSMGMTAGNHQTPNGTYYVQDKKASVVMDSSTYGVPVNSTYGYKVTVEDAVRFDNVGDYVHSAPWSVDDQGKRDVSHGCINISPANAKWFFDNFGPGDPIIVKNSSGGDYKKNDGSADWMN

SEQ ID NO: 5079 - protein, 201 aa, Mycobacterium paratuberculosis
MRSPREKMVVSAALLIRERGAHATAISDVLEHSGAPRGSAYHYFPGGRTQLLCEAVDFAGEYVAAVIAGAESGSRLLDTLIDTYREQLRDSDFRAGCPVVAVAVEAGEQSDAERPVIERAAAAFDRWTDLIAQRFVADGIRRRRAAELAVLATSALEGAIVLARARRDPAPLDVVHRQLRDLLAAELAGETAAGRKSRHDR

SEQ ID NO: 5080 - protein, 866 aa, Mycobacterium paratuberculosis
MTGEWQPSACILCECNCGIVVQVEDRRLARIRGDKAHPASQGYTCNKALRLDHYQNSRARLTSPLRRRPDGSYEEIDWDTAIVEIAEGFKRIRDSYGGDKIFYYGGGGQGNHLGGAYSGAFLKALGSRYRSNALAQEKTGESWIDGQLYGGHTRGEFEHAEVAVFVGKNPWMSQSFPRARVVLNEIAKDPARSMIVIDPVVTDTAKMADFHLRVRPGTDAWCLAALAAVLVQENLCDEAFLAEHVRGADGVRRALRDVAVCECAAHCGVDEELLRTAARRIGTADSVAVFEDLGVQQAPNSTLCSYLNKLLWILTGNFAKRGGQHLHSSFAPLFGQFSGRTPVTGAPIISGLVPSNVVPEEILTDHPDRFRAMIVESSNPAHSLANSAACREAFASLELMVVIDVAMTETARLAHYVLPAASQFEKPEATFFNLEFPRNTFQLRRPLLTPLPGTLPEPEIWARLVRALGVVTEADLRPLHDAARRGRHAYTEAFLTAVSTNPTVAQLLPFVLYETLGPTLPDGLRGAAALWGLAQKTALTYREAVRRAGHADGNALFDAILDNPSGVTFTVHDYADDFTLIGHPDHKIALEIPAMLQELAKLSSGPPRLTTEEFPIVLSVGERRAYTANDIFRDPSWRKRDAEGALRVSVEDAQALGLADGCRARISTAAGSAEATVEISETMLAGHAALPNGFGLDYIGDDGRTVVPGVAPNAQPHVAGHLGALVGLQVGAGTLEYLPQRLGDAIGPGAVEHLFDLARGAPVGVALQRAGDALPGGDVTALQSRTDGGGRPEFHRLVEVRQRGGRAAAAVALVPRGRPVRRRSRASVGCQRHLASSSIATATARQRCLICSQSAGASASGPWSSG

SEQ ID NO: 5081 - protein, 1007 aa, Mycobacterium paratuberculosis
MMRLSRSLRKYRWLVFAGWLLALVPAVYLALTQSGNLTGGGFDVAGSQSLAVHDQLEDLYHDQGGSSLALVAAPRADASYQDMNDAVAQLRRIAAEVPGTTEIPNPTQRPPQPDRPYVLSVRLDSRNTSDVAKQLRTKVGIKGDQPGQTANGRVRLYVIGQGALSAAAAANTKHDIAAAEKWNLPVILIVLLAVFGSLAAAAIPLALGICTVVVTMGLVYLLSAYTTMSVFVTSTVSMFGIALAVDYSLFILMRFREELRSGRQPREAVDAAMATSGLAVVLSGMTVIASLTGIYVINTPALKSMATGAILAVAVAMLTSTTLTPAALATFGRAAAKRSALLHWSRRPESTQSKFWNRWIGWVMRRPWMSALAASLVLLVMAAPAASMVLGNSLLRQFDSSHEIRAGVGAAAQALGPGALGPIRVLINFPDGGAASPEHSHTVGAVRQRMAQAPNIVSVSPPQFAEDNGSALLSAVLSVDPEDMKARETVGWMRAELPKVPEAGTARVDVGGPTALIKDFDDRVSATEPLVLGFVALIAFVMLLVSIHSVFLALKGVLMTLLSVAAAYGSLVMVFQWGWLRDLGFAQISSIDSTVPPLVLAMTFGLSMDYEIFLLTRIRERFLHSGNTRDAVAYGVSTSARTITSAALIMSAVFVGFAFAGMPLVAEIGVACAVAIAVDATVVRLVMVPALMAMFAQWNWWLPPWLSRVLPSVDFDRPLPEVDLGDVVVIPDDISALTAPSADLRMVLKSAAKLKHLAPDAICVTDPLAFTGCGRTTAAGADPARGLGPGQIPHQVALREEKVGVAAGPGEKTGSNGHTNGSAGAKKPAARNGRNGIAKAIAGADRPVHPVTLWRGRLSVALDALQTDPDSGTDRPRFRRRSPVETTNVQLPTGDRLLVPTGAETLRLKGYLLMCRNSRRDYADFADMVDALEPETAAVVLAGMDRYYCCESSRRQWIATQLVRRLADPDPCDYPDDQGPDADAPADWEQIRQRCLAVAVAMLEEAR

SEQ ID NO: 5082 - protein, 181 aa, Mycobacterium paratuberculosis
MTSASAGRRRRIFAGLIAAALPGAAVAVLAGPPATGANDPCAASEVARTIGSVSKSMGDYLDAHPETNQAMTSMLQQQAGPQSVNGLKSYFDANPKVAGDMTSIAQPLTSLSLQCKLPISIPQALGMVQQAQGAAGGLPALPGNPAGASPLGGAAGPAGTPPAVPQPAGPLSGPPRGNTVG

SEQ ID NO: 5083 - protein, 393 aa, Mycobacterium paratuberculosis
VPHDAPAHNLDLPREQTPRGRYWWVRWVILGVVAIVLAVEVSLGWDQLAKAWMSMYEANWWWLLASVVAAAASMHSFAQIQRTLLKSAGVHVKQLRSEAAFYAANSLSTTLPGGPVLSATFLFRQQRLWGASTVVASWQLVMSGVLQAVGLALLGLGGAFLLGAKNNPFSLLFTLGGFVALLLLAQAVASRPELIEGIGSRVLAWVNSVRGRPAETGLDKWRETLMQLESVSLGRRDLSVAFGWSMFNWIADVACLGFAAYAAGDHASVAGLTVAYAAARAVGTIPLMPGGLLVVEAVLVPGLVSSGMSLPSAISAMLIYRLISWLLIAAVGWVVFFFVFRTENIADSDDEPITGPLPVLPTPGGPPDPTDTALQGPLPPDRNPADPNPDKDV

SEQ ID NO: 5084 - protein, 382 aa, Mycobacterium paratuberculosis
MSANVDDASVEPIVRKTAAWAWRLLVILAAALALFWVLAKLEVIVVPVLVALLLSALLVPVVDWLDRHGLPRGGAVALVLLGGFAILGGILAFVVLQFIDGLPGLTEQVTQSIESTRRWLINGPAHLRSEQIDSAGNAAIEALHNNQAKLTSGALSTAATVTELVTAAVLVLFTLIFFLYGGRNIWRYVVQIVPAHARDRVHEAGSAGYGSLIGYVRATFLVALTDAAGVGAGLAIMGIPLALPLASLVFLGAFIPLVGAVVAGFLAVVVALLAKGIVYALITLGLLVAVNQIEAHLLQPLVMGRAVSIHPLAVVLAISTGGVLAGIVGALLAVPTVAFLNNAFQVLLAPNPSAEAVKQEEESDEQNTILQAEPDKPENGSG

SEQ ID NO: 5085 - protein, 988 aa, Mycobacterium paratuberculosis
VFAWWGRTVYRYRYIVIGVTVALCLLGGVFGISLGKHVTQSGFYDDASQSVKASVLGDQTYGRDRTSHVVATFTTPDGKTVDDAGWRDKVVAELNKFKADHPDQVVGWAGWLAAPDSTNPVIKGMVSEDKKHTFVSIPLKGDDDDTILNNYKAIAPDMQKLNGGAVQLAGLEPIANALTGTIATDQRRMEVLAVPMVAVVLFLVFGGAVAAGLPAIVGGLSIAGSLGILRLVAVFGPVHYFAQPVVSLIGLGIAIDYGLFVVSRFREEIAEGYDTEAAVRRTVMTAGRTVTFSAVLIIASSASLLVLPQGFVHSLTYAIFAAVGLAALLSITFLPACLGILGRHVDALGVRTAFRVPFLRNWKYSRAYLNWLADRLQKTKTREEVEAGFWGKLVNWVMRKPLAFAIPIAVGMILLVIPLGNLSFGGMSEKYLPPNNPVRLAQEHFDKQFPGYRTEQLTVVIQSDNHSKVTDQQVADIRNRISGIGGFTDKTWQERPCPTIAGNPCVPGPNGTTVPKDGSVRVIQNGLANRNDAAKKIAELRAVNPPKGLNLYVGGTPALEQDSIHSLFDKAPLMLVLLLGATLLLMFLAFGSVVLPIKAVLMSALTLGSTMGILTWIFVDGHLSGVLNFTPTPLMVVVIALVVAVGFGLATDYEVFLVSRMVEARERGMSTAEAIRIGTATTGRLITAAAMVLAVVASSFVFSDLVLMKYLAFGLMAALLLDATVRMVPGALGDEAARRRLLVGPALGPPAAEQDRAGRDRPARRAQAAHPQRPARPSAGGGQPGRRGAAPAARPHPPRGAGAVAGGAPRSRGASARAGTGREHHPHPGPAQPADRGPDDPLRRAGSARPPAAAGTTSGHPAAPARPGGAAVRGSDPRHPCARQPARRRRQRRGRRRTHHRPAEDAGGRLGRQRVRCGRRPGERARSGREWRPGAAAPPRRRRAVGPGPAAPRGPAVKAWKPLSRNRFRVCPALPAGWCSARRTLLPA

SEQ ID NO: 5086 - protein, 237 aa, Mycobacterium paratuberculosis
MSLTEATAAGAEPVAPPAVLSGDALGGFPPPGGRVLLVWDAPNLDMGLGSILGRRPTALERPRFDALGRWLLARTAEVSAERPGVVVEPEATVFTNIAPGSAEVVRPWVDALRNVGFAVFAKPKIDEDSDVDRDMLAHIELRRTEGLAALVVASADGQAFRQPLEEIARSGVSVAVIGFREHASWALASDTLDFVDLEDISGVFREPLPRIGLDSLPDQGAWLQPFRPLSALLTARV

SEQ ID NO: 5087 - protein, 259 aa, Mycobacterium paratuberculosis
MGHHGQMHAQHGVTMPADSPIGQPDRSEQRYFPATAFRTRRSTLSDAQRQTWDRRWPELGLSVGPAEDPDRPGPPLDTDAWFGRKAPVVLEIGCGNGTSTLAMAKEEPGVDVIAVEVYRRGLAQLLCAIDRDNVTNIRLIRGNALDVLQRLIAPASLTGVRVFFPDPWPKARHHKRRFLQPGTVGLIADRLLPGGVLHVATDHAGYAEHIADVGAGEPRLRPANPDSPLPISVARPTTKYETKAQDAGSAVTEFIWLRR

SEQ ID NO: 5088 - protein, 364 aa, Mycobacterium paratuberculosis
MRGQGHQIFVDELARFAAAEADPRVTAIAQRAAAPLRVVVRGRRGVGRRTLARALDRAGRATGIAVTTDAADVVVHVTAEVAKPEDTQAISTARAAGHPVLAVLSKADLVGSLSGRGGDGPIAAARARCADLSALIGVPIRPAIGLLAVAALDDLGDDLWAALRTLAADPAACLDGSITGFLGAGVDVPAAARERLLDTLDLFGTALAIAAIRRGAGPAQLRTLLRRISGVDAVLAEIGALGAEVRYRRVLGAVAELEALAVGGAALGERISGFLSRDDTVVARMAAALDMAGDMAGEVAGETAPGDPSGHLARAVRWQRYSRASGSDLHRACGADIARGSLRLWSQACATLPGERPVEREDPA

SEQ ID NO: 5089 - protein, 511 aa, Mycobacterium paratuberculosis
VSGDNPAAAVDALVAAVSPGLDPPAVHRSDAVLVTGPWMAGVTAVAAALQERLPQHKFVESTDLGPGEVPTAVVFVVSAAAHLTPSDCALLDAATEHTDAVVGVVSKIDVHRGWREVLAANRDTLAAHAPRYARVPWVGAAALPDVGEPDVDDLAKTVAAQLDDADLARRNRLRAWESRLRTVARRFDREVEAPGRRARVEALREERSTALQQRRQAKTERSITLRGQIQQARVALSHSARNRCASVRTELQEHAAGLSRGKLSGFEAHTRDRLAEVVAEVNDGTDTQLADTAQAVGVAVDLPALEQLPAVEVSPPPLKSRRQETWLMILFGVGFGLGVALTLSRLMSGLASRLSPALAVAAAVVCVLISVALTFLVINIRGLLRDRALLDRWAGDATASLRSVVEELVATRVLVAESVLSKALLAQDEAENAAVSASVSAIDTELREHALAAARAAAARDREMPAVTAALEAVRAELGEPGIQPGGSPAEDAGGAKTEKPASRSEDGDRP

SEQ ID NO: 5090 - protein, 609 aa, Mycobacterium paratuberculosis
MTSATIPGLDTAPTNHQGLLSWVQEVAELTQPDRVVFADGSDEEFNRLAAELVEAGTLKKLNEKKHPNSYLALSDPSDVARVESRTYICTEEESGAGPTNNWMDPTEMRSIMTDLYRGCMRGRTMWVVPFCMGPLGVEDPKLGVEITDSEYVVISMKVMTRMGKAALEKMGDDGFFVKALHSVGAPLEPGQKDVPWPCNDTKYITHFPETREIWSYGSGYGGNALLGKKCYSLRIASAMAHDEGWLAEHMLILKLISPENKAYYFAAAFPSACGKTNLAMLQPTIPGWRAETLGDDIAWMRFGKDGRLYAVNPEFGFFGVAPGTNWKSNPNAMRTIEAGNTVFTNVALTDDNDVWWEGLEGQPEHLIDWKGNDWYAGKTETPAAHPNSRYCTPMSQCPILAPEWDDPQGVPISGILFGARRKTTVPLVTQARDWQHGVFMGATMGSEQTAAAEGKVGTVRRDPMAMLPFLGYHVGDYFQHWIDLGKNSDESKLPKVFFVNWFRRGDDGGFLWPGFGENSRVLKWIVDRIEHKAGGQDTPIGIVPKAEDLDLDGLDVSVDDVAKALAVNPDEWREELPQIEEWFEFVGEKLPTGVRDEFEALKQRLSEAG

SEQ ID NO: 5091 - protein, 180 aa, Mycobacterium paratuberculosis
MEQRVRDRTAALERANEEIRRLSVTDELTGLNNRRGFYLLAGQKLSGSHRLGHACVLAFLDVDGLKQVNDEQGHDAGDMLIKDVAEVLRSIRRESDILARIGGDEFCVMVTESDQDSAPLRERLAEAFAAFNATGDRPYRLSASVGLVRAPVFDTASVDELLARADELMYVEKKARRTAG

SEQ ID NO: 5092 - protein, 173 aa, Mycobacterium paratuberculosis
MTAEQVSQPPASGSSRFAVYDYVDGMERLVHAVQELSLARSLPDIQRIVRSSARELTGCDGATFVLRDNDRCYYADEDAIAPLWKGSRFPMTSCISGWAMLNRDAAVIPDIYRDPRIPHTLYRPTFVKSLVMVPIRKLDPIGAIGNYWAEPHQPSEHEVRLLQALADSTSMAM

SEQ ID NO: 5093 - protein, 505 aa, Mycobacterium paratuberculosis
MQIREYLGAGKPAVILYPSGTVVTFDDLEARANRLAHRFRKAGLREGDTVAILMENNEHIHAVMWAARRSGLYYVPINTHLTAAEAAYIVDNSSARAIVGSAALRDTCARIGEHLPGGLPDLLLMADGDLDGWEHYPECVAGEPDTPIDDELEGDLLQYSSGTTGRPKGIKRELPHVHPAEAPGMMSALVGFWMTPESIYLSPAPLYHTAPSVWSMSAQAGGITTVVMEKFDAEGCLDAIQRHRVTHGQFVPAMFTRMLKLPEAVRHSHDLSSLQRVMHAAAPCPVEIKKQMIDWWGPIIDEYYASSEAIGSTLISAEEWLAHPGSVGKPMACEIHILDENGNELPPGQAGEIYFSGGYSFEYLNDEAKTAASRDKHGWVTVGDVGYVDEEGYLYLTDRRHHMIISGGVNIYPQEAENLLVTHPKVLDAAVFGVPDDEMGQRVMAAVQTVDPGDATDEFGAELLSWLRDRLAHYKCPRAIAFEEQLPRTDTGKLFKNGLIEKYSV

SEQ ID NO: 5094 - protein, 320 aa, Mycobacterium paratuberculosis
MLRVVDLSSAPQDGPASPPGVIVAVGSADQIARSEFWLEAATFTLTEDACTDRRAVTVDSVSTSLDELTARCRRWPHASAICDDVLRAVDPTAPAARGLVTESLAYSTLQAGPEFVRWLDERGPARMPEIADPVLARRDGDVLRIAFNRPQRHNAFSTDARAALLEALAVAQLDPSVTGIVLSGNGPSFCSGGDLAEFGTFADPASAHLARTRHSPALVLDALTARFGRACRAEVHGRVLGSGLEMSAFCGWVSARDDAVFGLPELALGLIPGAGGTVSITRRIGRWRTAYLVLSGRTVGAATALSWGLVDEVEAATASS

SEQ ID NO: 5095 - protein, 405 aa, Mycobacterium paratuberculosis
VGANSRVFAQQVDVRRESVRWAQVNDEEDMLVATVRAFIDREVKPTVREVEHADAYPEAWIEQMKRIGIYGLAVPEEYGGSPVSMPCYVRVTEQLARGWMSLAGAMGGHTVVAKLLTLFGTEDQKRAYLPRMASGEIRATMALTEPGGGSDLQNMSTTALPDPDSDGLVVNGAKTWISNARRSGLIALLCKTDPKATPRHKGISILLVEHGPGLTVSRDLPKLGYKGVESCELSFGNFRAPATAVLGGVAGQGFSQMMKGLETGRIQVAARALGVATAALEDALAYAQQRESFGQPIWQHQSVGNYLADMATKLTAARQLTRYAAERYDSGERCDMEAGMAKLFASEVAMEIALNAVRIHGGYGYSQEYDVERYFRDAPLMIVGEGTNEIQRNVIARQLVTRGGI

SEQ ID NO: 5096 - protein, 340 aa, Mycobacterium paratuberculosis
VTSDGYARIREGGPYFDDLSVGQVFDWAPSVTLSSGLAAAHQAILGDRLRLALDADLCAAVTGLPAPLAHPGLVCDVAIGQSTLVTQRVKANLFYRGLVFHRFPVIGDSLYTRTEVVGLRANSPKPGRAPTGMAALRMITIDQADQLVLDFYRCGMLPASPEFTAEAGSVPHDDLSGIGADVPGPAHDPTAQWDGAVFRTEVPGPHFDRALAGSVLHSTGDVVSSAPELARLTLNIAATHHDSRVGGRRLVYGGHTIGLALAQAARLLPNLVTVLGWRSCDHTGPVHEGDTLYSELHIESARPTEHGGVLGLRSLVYAVSDTPDEPDRAVLDWRFDALQF

SEQ ID NO: 5097 - protein, 416 aa, Mycobacterium paratuberculosis
LSRTPASTAMSTAASTAPSTMGDVSAAATDWGGSGLAYLTGLPNGPADFSRAPVLSRAHQVAAAIGARLGVDADAAVLLSGRAALLGLRRAGQVSPGGATRLLAARDGYCALTLSRADDLAAVPALLQVDDVAGDPWPALRCWAAGRATAEIVERAALLDIPAAALGEARPAAEHIQPTAPGGAPRSPRGLLVADLSSMWAGPLCGQLLARAGATVVKVESPRRPDGTRAGNRAFFDWMNHGKLCYGIDFDRDADQLRELLTVSDIVIEGSRPAALRRRGLGPADIAPRPGRIWLQITAFDDDRPGFGDDAAVGGGLVGTSAAGPVFCGDAIADPLTGLQAALAVAESLGRGGGELIRLSMAGVAAGYAALGTEPPTSDAPVSPPAPPPPSGPASALGADNAAVRHLVSQRRCLSC

SEQ ID NO: 5098 - protein, 437 aa, Mycobacterium paratuberculosis
MLIQRATLLDGTAADIRVGARIEEVAPADDGLAARAGEGVLYAGGGTVLPGLHDHHVHLRSAASALDSFFVGPPGVSTRAELTRLLANATPGPDGWIRAVGYHDSVAGALDRTALDAIVRDVPVRIQHRSGALWILNSEALGRIGLAEHPDGRLRSADRGWSQALAHRETDLAELSRRITATGVTGVTDATPDLDDDDRAALAAAHARGEFRPRPSFLSPGKKILHDDRLDLDALTEWVAGQHDTGQPVAVHCVTAAQLVVAIAALRAAGTHPRDRIEHAAVVPDDNLADLAELGVTVVTQPNFVAERGDQYLAEVPADEHDQLWRLASLRDARVPVALSTDMPFGHGDPWTAMRAAVHRTTPSGVVLGTRECVSARTALTMFLGQADQPDRVRSVQPGEPGDLCVLNEPPHTALAELDAGMVAATIIGGELVYFAM

SEQ ID NO: 5099 - protein, 299 aa, Mycobacterium paratuberculosis
VPNNDVHPDLQRFARFAPRRLVGPRTLPLMRVALAWRGRLGKPVRDVEVITLGSGVGVRLFRPAGAAETTPALLWIHGGGYVLGTAQQDDQLCSRFSRRLGITVASVDYRLAPEHRYPAPLEDCYTALTWLAGLPSVDRYGIAIGGASAGGGLAAALALLARDRAEVSPAFQLLTYPMLDDRSSDTAPSPNYRLWDNRSNRFGWAAYLGDADPHVAVPARRDDLSGLPPAWIGVGTHDLFHDEDLAYAERLRAAGVPCQVETIPGAFHGFDLILPKVQVSQRFFDSQCNSLRAALTPAG

SEQ ID NO: 5100 - protein, 415 aa, Mycobacterium paratuberculosis
VWAIARFADRDGGTVPAMAPGMTPYLKWLLRARPADYALAVSLAGASLPVVGRHLEPLAGLTAMGMWGARHAPEVISAATRDMFAPGGGDARRRDRESTQQVSLAALRGLVSAAELESQWPVAQRTPPIWDGVRRHRHLYRRAVHYGHHPAQVLDVWRRKDLPAQPAPVLIFVPGGAWVHGKSMGQGSALMSRLAEQGWVCLAIDYRVAPHHRWPRHIVDVKTAIAWARANVDKFGGDRNFVAIAGCSAGGHLSALAGLTPDDPQYRGMLPEGADTSVDAVVGIYGRYDWEDRSTPERVRFVDFLERVVVRKSIARHPEVFRDASPIARVHRNAPPFLVIHGSKDSVIPVEQARSFVERLRAVSHSTVGYLELPGAGHGYDLIDGERAGAAAHVCSLFLDQVHRSKTRIGAKEVI

SEQ ID NO: 5101 - protein, 469 aa, Mycobacterium paratuberculosis
VKRLSGWDSVLLYSEAPNVHMHTIKAAVIELDADRRSLDVAAFRQVIAGRLNKLDPFCYQLVEVPFSFHHPMWRENCEIDLDYHIRPWRVSPPGGRRELDEAIGQIASTPLDRSRPLWEMYFVEGLANNRIAVVGKIHHALADGVASANLLARGMDLQPGPEGGPYVCDPPPTTRQLMVSAFADHLRHVGRLPHTIRYTAQGLGRVRRSARKLSPELTRPFEPPPTFMNHKLTPERRFATATLALADVKETGKRLGATINDMVLAMSTGALRTLLLRYDGQAQPLLASVPVSFDFSPERISGNRFTGMLVALPVDHDDPLERVAACHQNAISAKESHQLMGPELVSRWAAYMPPAPTRAFFQWASARDGHNKILNLNISNVPGPRERGRVGGALVTEIYSVGPLTAGSGLNITVWSYVDQLNISVLTDGATCKDPHEVTEAMVQDFIEIRRAAGFSEDLTVVEAAMAPA

SEQ ID NO: 5102 - protein, 264 aa, Mycobacterium paratuberculosis
VRHVSTGNEEAGEPEVLVEQRDRILIITINRPKAKNAVNAAVANGLAAAVDRLDNEPGLSVGVLTGAGGSFCAGMDLKAFARGELPIVEGRGMGFTERPPAKPLIAAVEGYALAGGTELALATDLIVASKDAAFGIPEVKRGLVAGGGGLLRLPQRIPSAIAMELALTGDNLSAERAHALGMVNVLAEPGAALDEAIALAEKIAANGPLAVAATKRIIVESRGWSPETMFAEQNKLLAPVFSSNDAKEGAIAFAEKRPPKWTGT

SEQ ID NO: 5103 - protein, 509 aa, Mycobacterium paratuberculosis
MSISLLLEMAASSNAERTAVVSQDVRLTTQELSDLADGGAAVVAGSNAKHLVYVGTGGVLLPVLIFAAARAGVAFTPINYRLSAEGIRALIERLPEPLVVVDARYRDMVGEAPGGVMDSDDFLAAARAAEPAADAFADPDSVAIVLFTSGTTSQPKAVELSHNNLTSYITGTVEFGAADETDAALICVPPYHIAGVSAALSNLYAGRKMVYLPNFDAREWVRLINAENVTTATVVPTMLDRIVTVLENGDPDTGAPIELPSLRNLAYGGSKVGLPLVRRALELLPHVGFVNAYGLTETSSTIAVLTPDDHRAALAATTPEAARRLGSVGQAVAGIELQIRDEAGNVLPPGETGELFVRGEQVSGRYTGIGSVLDEDGWFPTRDIAMLDDEGYLFIGGRSDDTIIRGGENIAPAELEEVLVEHPHVRDVAVVGVEDPQWGQAIVAVVVPAAGVDPDPEELREFVRKSLRGSRTPDEVVFRDELPTTATGKVLRREIIATLAGLRAAPAQQ

SEQ ID NO: 5104 - protein, 87 aa, Mycobacterium paratuberculosis
VCDTQVIVVRSADSLDDLRCGGVPMVPVGAERSGELDPSFADGTVMGKRYVDETGAEVLVTKPGAGSLSIGQTPLQLKEVKPLPASD

SEQ ID NO: 5105 - protein, 261 aa, Mycobacterium paratuberculosis
LSSTSRATNSPARCPTCGAAPSASAHVTCTGRHCGIRTRPDAGPGLTDRADHQAAGPAKRGGTRTKMLASAAEVMRERGAAGVTIDAVLARSGAPRGSVYYHFPDGRNQILAEALRYSGDSITALIDQAAGRGGRALLREFVEYWERLLTEGGFTAGCPVVAAAIGCSEDEGPKLSAEAGAILGRWCTALTRAFVNDGFDDADAASLAVMSIAALEGGIVLSRSTRNAGPLHQVGEQLEFLIKAREFVVRNKIPGKQPGSR

SEQ ID NO: 5106 - protein, 493 aa, Mycobacterium paratuberculosis
MSDIQTQAKTEYDKLFIGGKWTEPSTSEVIEVHCPATGEYVGKVPLAAAADVDAAVAAARAAFDNGPWPTTPPKERAAVIANALKVMEERKDLFTGLLAAETGQPPTSVETMHWMSSIGALNFFAGPAVDQVKWKEVRTGGYGQSIVHREPIGVVGAIVAWNVPLFLAVNKLGPALLAGCTVVLKPAAETPLSANALAEAFAEAGLPEGVLSVVPGGIETGQALTSNTDVDIFSFTGSSAVGREIGRRGADMLKPCTLELGGKSAAIVLDDVDLPSALPMLVFSGIMNSGQACVAQTRILAPRSRYDEIVDAVSTFVQSLPVGLPSDPAAQIGSLISEKQRARVEGYIAKGIEEGARLVCGGGRPEGLDSGFFVQPTVFADVDNKMTIAQEEIFGPVLSIIPYDTEEDAIKIANDSVYGLAGSVWTADVQRGIAVSEKIRTGTYAINWYAFDRCCPFGGYKNSGIGRENGPEGVEHFTQQKSVLMPMGYTLEG

SEQ ID NO: 5107 - protein, 255 aa, Mycobacterium paratuberculosis
VAVTDIFARRATLARSVRLLSQFRYERSEPARFYGALAADTAAMVDDLWRAGHGESAAGRTLLDVGGGPGYFAAAFTDAGVRYLGVEPDPGEMHAAGPVVAADTGTFVRASGMALPFADDSVDICLSSNVAEHVPRPWQLGAEMLRVTRPGGLAVLSYTVWLGPFGGHEMGLTHYLGGARAAERYARKHGHPAKNNYGSSLFEVSVADGLAWAASTGAALAAFPRYHPRWAWSLTSVPVLREFLVSNLVLVLQPQ

SEQ ID NO: 5108 - protein, 388 aa, Mycobacterium paratuberculosis
MSSLRSVLLLCWRDTGHPQGGGSEAYLQRIGAQLAAAGIAVTLRTARYPGAPRRDVVDGVRISRAGGRYSVYIWALLAMAVARLGLGPLRTVRPDVVVDTQNGLPFLARLIYGRRVVVLVHHCHREQWPVAGPVLGRLGWFVESTLSPRLNRRNQYVTVSLPSARDLVALGVDGTRIAVVRNGLDEAPAPSLSGPRAAAPRVVVLSRLVPHKQIEDALEAVARLRPRVPGLHLDIVGDGWWRQRLVEHVQRLGIGSAVTFHGHVDDVTKHHVLQGAWVHLLPSRKEGWGLAVVEAAQHRVPTIGYRSSGGLSDSIVDEVTGILVDTHAELVDRLEQLLADPVLRDQLGAKAHTRSGEFSWAQSADAMRGVLEAVHAGRTVSGLVSGRG

SEQ ID NO: 5109 - protein, 565 aa, Mycobacterium paratuberculosis
VRWTRPGYALVLALLVVGPLLRPGYLLLRDAVSTPRSYLSDTALGLTAAPRAAPQDFAVALASHLVDGGVVVKTLLLLGLWLAGWGAARLVALVLPDAGMPGEFVATTLAIWNPYVAERLLQGHWSLLVGYGCLPWVATAMLGLRTGGAGFFGLAFFIALAGLTPTGLLLAAAVALACVPVAGAGRRRWVCAAAAIGAAAAAALPWLVAAVTGAALPSHTPANRLGVEAFAPRAEPGLGTLTSLASLGGIWNADAVPGSRTTLFAVASAVVLLGVVAVGLPAVARRPAAVPLLVLAAAAVLIPAGLATAPGLRLLGAVVDAAPGVGVLRDGQKWVALAVPGYALAGAGAVLTLRRRLFGAAAPALVCCLALILALPDLVWGVGGKVSPVRYPRGWPAVAAAINARPDAVAVLPAGTMRLFSWSGPAPVLDPLPRWVRADVLSTGDLVISGTTIAGEGAHARAVQELLLSGPDPAALAAAGVGWLVLEADSAGEVGAAAHTLGAAAPVYRDDEIALYRIGGHTAGVAADRRAATLIAHLAWLVLLLGSGAGVLVGAWRRRGVSRAR

SEQ ID NO: 5110 - protein, 413 aa, Mycobacterium paratuberculosis
MLRFAACGIIGLGAALLIAALLLTTYTTSRITKVPLDVDATLISDGTGTALDSASLSTDHVVVNQNVPLVSQQQISVESPANADVVTLQVGSSLRRTDKQKDTGLLLAIVDTVTLNRKTATAVSDDTHTGGAVQKPRTINDENPPTAIPLRHDGLSYRFPFHTEKKTYPYFDPIAQKPFDVNYDSQEDVNGLTTYKFTQNVGYNADGKLVAPVAYPSLYADQATDSKFTAPASMWGIQGGDPNEQITMTRFYAAQRTFWVDPVSGTIVKQTEHAHHYFARDPLKPELTLADYKVTSNEDTVESQVNAARDERDRLALWSRVLPITFTAVGLIALVGGGLLASFSLRSESALTDPGLDRGDQDFFGRSGLEEPVSGAEAETEKLPTQRPDLRSESGPDEPTEAGPTEAKPPDRE

SEQ ID NO: 5111 - protein, 408 aa, Mycobacterium paratuberculosis
MPGCTRSPGRAHRQTVVVSDDRRVGGVRSFLPAVEGMRACAAMGVVVTHVAFQTGHSSGVDGRLFGRFDLAVAVFFALSGFLLWRGHAAAARDLAPRPRTGHYLRSRVVRIMPAYLVAVVVILTLLPDADHPSPTVWLANLTLTQIYVPLTLTGGLTQMWSLSVEVGFYLALPVLALLARRLPVTARVPAIAALGALSWAWGWVPVHPGSGLNPLNWPPAFFSWFAAGMLLAEWVHGGIGRPVRLAQSRAGRVLLAVVAVVAYLVAASPLAGPEGLVPGTPAQFAVKTAMGSLVAFALIAPLVLDRMDTPHRVLGTTVMVTLGRWSYGLFIWHLAALAMVFPVLGTFPFTGRMPAVLVLTLIFGFAIAAVSYALVESPCREALRRWEKRHQPAAPRQLIDAEADAIAP

SEQ ID NO: 5112 - protein, 326 aa, Mycobacterium paratuberculosis
VSELNTARGPIDTAALGVTLMHEHVFIMTTEIAQNYPEAWGDEEQRVADAIDRLNELKARGVDTIVDLTVIGLGRYIPRIARVAAATELNIVVATGLYTYNDVPFCFHYLGPGAELGGPEIMTDMFVRDIEQGIADTGIKAGILKCATDAPGVTPGVERVLRAVAQAHKRTGVPISTHTHAGLRRGLDQQRIFEEEGVDLSRVVIGHSGDSTDVGYLEELIAAGSYLGMDRFGIDAISPFEDRVNIVAQMCERGHADKMVLSHDANCYFDALPEELVPQVMPNWHYLHIHNDVIPALKQRGVTDEQLHTMLVDNPRRIFERQGPYG

SEQ ID NO: 5113 - protein, 569 aa, Mycobacterium paratuberculosis
MLLNPNHLQRRYPDRRSAEIMAATVDFFESRGKARLKSDDHERVWYSDFLEHIGRERIFASLLTPTRYGAPDCRWDTYRISGFAEILGFYGLNYWYPFQVTALGLGPIWMSGNDEAKRKAAGLLEAGEVFAFGLSEQTHGADVYQTDMNLTPAPGGGWTAAGQKYYIGNANVARMVSTFGKFAGGATDSEYVFFAADSRHERYRLIKNVVNSQNYVGNFALCDYPVTEADILHRGPEAFHAALNTVNVCKYNLGWGAVGMCTHAMYEAVTHASNRILYGTVVTDFSHVRRLLIDAYARLVAMRLVATRACDYMRSASATDRRYLLYSPLTKAKITGEGERVITALWDVIAAKGVEKDTIFEAMTREIGLLPRLEGTVHINVGLLGKFMPNYLFAPSGELPVIGRRDDAADDEFLFAQGPTGGLGKVRFGDWRAPFDGFAHLPNVALLRAQIDVLAEMLASATPDALQQKDIDFAFAVGQLFATVPYAQLILEEATLSGVDDALIDEIFGVLVRDFNAYAVELSDKPATTEQQARFAMRMIRRPVHDPARYDQIWKEQVLPLSGAYQMRP

SEQ ID NO: 5114 - protein, 329 aa, Mycobacterium paratuberculosis; identical to SEQ ID NO: 4503

SEQ ID NO: 5115 - protein, 227 aa, Mycobacterium paratuberculosis
LPTVTWARVDPARRAAIIEAAESEFGAHGFSRGSLNVIARKAGVAKGSLFQYFADKRDLYAFIADIGSQRVRGYIEQLIRELDPARPFFEFLTDLLDGWVAYFADHPHERALHAAATLEVDTEARISVQNVIHRHYLEVLRPLVRDARLRGDLRADSDTDALLSLLLLIFPHLALAPYMRGLDPVLGLDEPTPEQPALAVRRLVAVLAAAFSPAPAHFATPRSEEVT

SEQ ID NO: 5116 - protein, 311 aa, Mycobacterium paratuberculosis
MNRTRSASMAQGGLNWDSLPLKLFAGGNAKFWNPADIDFSRDRADWERLTDDERSYATRLCAEFIAGEESVTQDIQPFMAAMRAEGRLGDEMYLTQFAFEEAKHVQVFRMWLDAVGVTDDLHHFLDDVPSYRTIFYEELPDCLNALTIDPSPAAQVRASVTYNHMVEGMLALTGYFGWHKICVERGILPGMQELVRRIGDDERRHMAWGTFTCRRHVAADDANWGVFETRMNELMPLGLRLIEEGFALYDPMPFDLSVDEFMAYASDKGMRRFGTIASARGRPLAEIDLDYTPVQLEDTFADEDARALAAV

SEQ ID NO: 5117 - protein, 472 aa, Mycobacterium paratuberculosis
VPIATINPATGETVKTFTPASDAEVDAAIARAYERFLDYRHSTTFAQRAQWANATADLLEAEADEVAAMMTLEMGKTLKSAKAEALKCAKGFRYYAQNAEQLLADEPADAGKVGAARAYIRYQPLGVVLAVMPWNFPLWQAVRFAAPALMAGNVGILKHASNVPQSALYLADVITRGGFPEGCFQTLLVPSSAVERILRDPRVAAATLTGSEPAGQSVAAIAGDEIKPTVLELGGSDPFIVMPSADLDEAVKTAVTARVQNNGQSCIAAKRFIVHTDIYDAFVDKFVEQMKALKVGDPTDPATDVGPLATESGRDEIAKQVDDAVAAGATLRCGGKPLDGPGWFYPPTVVTDITKDMALYTEEVFGPVASMYRAADIDEAIEIANATTFGLGSNAWTNDAAEQQRFIDDIEAGQVFINGMTVSYPELGFGGVKRSGYGRELAGLGIRAFCNAKTVWIGSSKSGDAGGGSKVE

SEQ ID NO: 5118 - protein, 52 aa, Mycobacterium paratuberculosis
VLGETSDFQPATIVANGRCRMSKAAELIVKCLENEGVSVVFGLPGEENIRFV

SEQ ID NO: 5119 - protein, 506 aa, Mycobacterium paratuberculosis
VLTRHEQAASFMAEMYGRVTGRAAVVSATLGPGAINMQLGVADATTNSTPLVAISAQVGHDREFKESHQYVDLVSMFAPITRWAAGIPTARAIPEMVRKAFKLAESERPAAVYLAVPEHIDADETDYDLGPLPRNVVRPDAPSPRQVERAAQILRNAKRPVVLAGHGAARADATKALVRFSEEFGIQVANTFHGKGVMPDDHPNSIGTLGFMRHDYVNFGFDHADAVIAVGYELQEFDPVRINPQADKKIIHMHRFPAEVDAHYSVDVGIIGDISDSLNALTDALSGHRFEHAADVPGSGLLTDEFARGQQDSRYPLAPARVVADTRAALGRSDVVLVDTGATKMWMARLYPTYERNTCLISNGLSTMSFALPGALGVKLAQPESRVLAVVGDGAFLMNSQEIETAVRERIPLVVLIWEDGGYGLIEWKMDLELGAHYYVKFANPDVVTYAESFGAKGYRISHADELLPTLRAALDDDGVSLISCPVDYSENLRLTNRLGELDETL

SEQ ID NO: 5120 - protein, 309 aa, Mycobacterium paratuberculosis
MLFRQLEYFVALASERHFARAARACYVSQPALSEAIRKLEQELNVPLVRRGQKFEGLTPEGERLVLWARRILADHDALKQEVAALQTGLTGELRLGVIPAASSIVALLTDPFCAAHPLVRVQLETSLRSAEIVQRLRRFELDAGVLYPDRQDVADLLVTPLYTEQQVLIAGAELLPDPSETISWSDALTLPMCLLNQGMRGRRLIDDALAALELTVTPQLETDSVATLLAHVGTGRWASIIPQTWIHSLRPPAGARILRLENPTVTATVALVTSATEPGSVLTRALVQTARGAGINDVLRKAAPGYSAG

SEQ ID NO: 5121 - protein, 458 aa, Mycobacterium paratuberculosis
VLRKRRIHRPQGRFHLRRDHEPLPARAVPRFGGRREHRRRHHLAPPLDPSRGRAMKDFRAPVNGVDGDSASALVAVPKSQGAQTIRPDSVSRLVGALLDDHAAVVGRVRSVIRSRLPVYRSVADEALEAELEWVLRSAVGGREALHEPQIAGLAAIGEARAHDGVPVDDMLRAWRIGVEVVVECAREAARRLGVDDARVLELVQSALAWSDIAMATSAKAHRRTERALALEAEESDAEFVRGALMGSLPAAELRMHAELRGLDPGAEYVAVRARLGGDGPHLRLEQSLGFQDPAHSRRGLCALLDGDLAGFLIEPPRDVEGVVGFGPPRPLTRLSESYRMAARALVTAEACGLRGAYDIAALGLRTAVAIDADVGELLRKRYLEPLSVGGSSRELIATVRTYLACGMHVERTATRLFVHQNTVRYRLARFEELTGASLRDTEVVTEVWWVLELAAMRL

SEQ ID NO: 5122 - protein, 125 aa, Mycobacterium paratuberculosis
VDAMRRVDYVIQYVESLERSVTFYRDVIGLEVRIEGDGYVEFEMPNTKFSLFERSKLPELIGREGGTAPCGEIGFLVDDVDEEATRLRGLGVEILSGPVDRPWRERTLHIADPDGNVIEFAQKLR

SEQ ID NO: 5123 - protein, 336 aa, Mycobacterium paratuberculosis
MPDLARRLRRTLWPIAQTTVAAGLAWYLAHDVLDHREPFFAPIAAAVCLWMTNRVRAELAVEMIIGVALGIGAGTVVLAVFGAGPIGMGAAVMLSLTLAVLIARSFSTQRSMFVNQSLISAILIMAFPHTGLGVERLYDALIGGGLAVVFSILLFPKNPLAVLHDASGELLTALHDILAQICCRSADSASPDQGWALSAADRLQRCSASLIEARGTAGQLARVCPRRWPLRGAVGAADRQVVHVALFGSSVLQLTRTLMSVRIRGGPHAEAFRAAVDDLRDADSALAAGHPATAAAHAESARRHSAALPAGSPASVAVVIDACIDELQQAIGPRRS

SEQ ID NO: 5124 - protein, 389 aa, Mycobacterium paratuberculosis
MEEEPVAKCVMVLYPDPVDGYPPKYARDSIPVINSYPDGSSLPTPSKIDFTPGELLGCVSGALGLRKFFEDGGHELVVTSDKDGPDSEFERELPDADIVISQPFWPAYITKERFAKARNLKLALTAGIGSDHVDLAEAQARGVTVAEETWSNSISVAEHTVMQILALVRNFVPSHQWIRDGGWNIADCVQRSYDVEGMDVGVIAAGRIGRAVLERMKPFGVNLHYFDVHRLSPEYEKQLGVTYHPDVESLARSVDVVSIHSPLIAQTHHMFNEKLLKSMRRGSYIVNTARAEETDHKAIVAALESGQLAGYAGDVWFPQPPPPDHPWRTMPNHAMTPHISGSSLSAQARYCAGTREILEDWFAGRPIRSEYLIVEGGKFAGTGAKSYAQ

SEQ ID NO: 5125 - protein, 145 aa, Mycobacterium paratuberculosis
MQAEDQVSPREMVRRGLLLDGLRQPVDLNAVDWHVRQRHPGAAPSEVQDATLAVIRSLVSDGLVRLGAQVMVGEHLGGVATEGERFVAWDQPLERSMHKISHVYLKHYDDPEKWMYAAWMQLTDKGEQLARSFEQADLDSYRKFQ

SEQ ID NO: 5126 - protein, 167 aa, Mycobacterium paratuberculosis
LPTDFELGRTLMTENFTTTNAGAPAPSDELSLTLGPDGPVLLQDFYLIEQLAAFNRERVPERQPHAKGTGAFGRFEVTNDLSALHQKPRCFSRGTKTDRVRAAVGERRRARQRRHRAGHARVFGEVLHHRGQLRPRRPRLPGLRHPGPDQVPADGPLGQTPREQRLP

SEQ ID NO: 5127 - protein, 399 aa, Mycobacterium paratuberculosis
VFVRLSGNAGERGSADTVRDTRGFSVKFYTTEGNFDLVGLDFPVFVIRDPIKFPQMVRSAKRRANNDCRDHNMQWDFWTLSPESAHQVAMIMSDRGIPKTFRHMHGFGLHTFSFLNAAGEISWVKFHFKSNQGIEWLTQEEGDRLAGTDPDYCIRDLYEAIERGDHPSWSVKVQIMPFEEAKTYRFNPFDVTKVWPHADYPLIDLGTMTLDRNVTDHHTEVEQVTFAPHALVPGIGLSPDKLLLGRSFAYADAHRYRVGANHNQIPVNAPRCPVRSYSKDGQMRFVNSTDPVYAPNSYGGPKADPDRASVVKWAVDGGMMVRAPYTLRPDDDDWGQAGALVRDVMDDAERERLVHNIVHHVTDGVKEPVLSRVVEYWYNIDADIGKRVEDGIRAANLGR

SEQ ID NO: 5128 - protein, 484 aa, Mycobacterium paratuberculosis
MAENHTTTNAGAPAPSDELSLTVGPDGPLLLQDSYLVEQMAAFNRERVPERQPHAKGAGAYGRFEVTADVSEYTKAAFLQPGAVTEVFARFSSGNSGERGSADTARDNRGFSVKFYTTEGNFDLVGSDVPVFAIRDPMKFPNLIRAGGRRADNDLHDHNMVWDFWTSCPETAHLVTLVMGDRGIPRTFRHMNGFGLHAFSWVNSAGEIHWVKYHFKTDQGIQWLPQEEGRRLAGTHPDCCVRDLYEAIARGKYPSWSLQVQLMPFADAKTYRFNPFDVTKVWPHADYPPIEIGTMTLDRNVTDHHAEVEQAAFAPSNLVPGTGLSPDRLLLGRSFAYPDAHRARIGVNHDQLPVNAARCAVRSYAKDGRMRFVNTADPVYAPNSAGGPQADPARAGEVHWAADGQMLRAAYTLRRDDDDWGQAGTLVRRVMDDSQRERLVHNIVGHVSAGVNEPVLSRVFAYWRHVDADIGRKVEEGVRANLNS

SEQ ID NO: 5129 - protein, 618 aa, Mycobacterium paratuberculosis
MLLTAGRNPYPGRQRGFPRVRCGPLNTRVFEEEIMSHAQPNVVDGAHFDFVVVGGGTAGNVVAGRLAENPNVSVLVVEAGVGNPWELDGVNTPGTAMELRHSPYDWDYLAKFVDRGVWQRIDKQETRGKILGGSSAANYFSWIPGCKPTYDRWAEYGGPEWTWQPLLPYLRKSATYHDDHGTFSPDMKRIGAGGPLPISHNNIPELQPFRDVVAQAWKSRGLPVTENIYDGEMNGLTHAVSTIYRGVRSGSYLFVKDRPNITILPEVRSKRLIIDYADRTCKGVTVIDASGTERSFYANREVILSQGVFESPKLLMLSGIGPGRELAKHGIPVVVDSRHVGQHLFDHPGVPFVLRIKEGYAIDDYLRPGAKHDSAVADYQKDHQGPLGSGLLEMIGFPRVDEYLDRDPIYREAKAANGGLDPFSPEGQPHFELDFVPAFGSAFQWQYPTPPEGDHITVMVDLVRPAYDGGGEVTLNSTDPFMQPNLNLNYLSNELDIIALREGIRLAYDILTKGDGFKDLVISQYPWDMPLHSDELMRTSIQDRVQTSYHPCGTNRLSKNIDQGVVDPKLKVHGVNKLRVVDASVFPIIPDCRIQNTVYMVGEKGADAIKADHTDLYK

SEQ ID NO: 5130 - protein, 485 aa, Mycobacterium paratuberculosis
MSWFSAPDYWVGRLVLERGVAVIYLLAFVAAAAQFRALIGEHGMLPIPRFLAGQSWRRTPSIFHLHYSDRLFAALSWFGAALSAAIVAGAADAVPLWAAMLMWLTLWVLYLSIVNVGQTWYSFGWESLLLETGFLMIFLGNAEVAPPLLTLWMARLLLFRVEFGAGLIKMRGDPCWRDLTCLYYHHETQPMPGPLSWFFHHLPKPLHRIEVAGNHFAQLIVPFGLFAPQPVAGVAAAIIVVTQLWLVASGNFAWLNWVTILLACSAIDDSSVALLLPKSVLPGHGEPSASPLWFVVVVVAVTAAVLVMSYWPIRNMLSSRQRMNMSFNSFHLVNTYGAFGSIGRVRREVVIEGTADEDITDQTVWREYEFKGKPGGVRRLPRQWAPYHLRLDWLMWFAAISPGYAQPWLTPFLQRLLENDRPTLRLLRHNPFPDAPPRYVRARLYEYRFTTPAELRRDRAWWHRTLIGGYVPPLTLSKLTPQDHG

SEQ ID NO: 5131 - protein, 1393 aa, Mycobacterium paratuberculosis
LWLVGAIALALTFAQSPGRISPDTKLDLTANPLRFLARATNLWNSELPFGQAQNQAYGYLFPHGTFFLIGHALGVPGWITQRLWWALLLTVGFWGLLRVAEALGIGSPGSRVIAAAAFALSPRVLTTLGSISSETLPMMLAPWVLLPTILALRATGPRSVRALAAQAGVAVALMGAVNAIATVAGCLPAVIWWACHRPNRLWWRYTGWWLVALVLATLWWVVGLVMLRAISPPFLDFIESSGVTTQWSSLVEMLRGTDSWTPYVAPTATAGAPLVTGSAAVLGTCLVAAAGLAGLAGPTMPARGRLVTMLLVGVVLMAAGYSGGLGSPAAHAVQAFLDAGGAPLRNVHKLGSVIRIPIVLGVAQLLGRIPLPGSAPKSLWLSAFAHPERDKRVATAVVVLTALMVSTSLAWTGRLTPPGTFTAIPPYWQQTADWLTQHNTGSSTPGRVLVAPGAPFATQVWGTSHDEPLQVLGASPWGVRDSIPLTPPQTIRALDSVQRLFAAGRPSLGLADTLARQGISYVVVRNDLAPDTSRSARPILVHRAVDGSPGLHKVAQFGAPVGPGTVAGFVADSGLRPRYPAVEVYRVDAGGDAGTPYFVDTDRMARIDGGPEVLLRLDERRRLLGQPPLGPALLTADARAAGLPLPAGAGVTVTDTPVARETDYGRVDQHSSAIRAPGDARHTYNRVPDYPVPGADPVLGAWTGGRITVSSSASDSTAMPDVAPATSPAAAIDGDPATAWVSNSLQSAVGQWMQIDFDHPVTNAALTLTPSATAVGAQVRRILIETATGSTTLRFDQPGKPLAAALPYGETPWLRITAAGTDDGSPGVQFGITDLTVTQYDASGFAHPVDLRHTVRVPGPPPESPITRWELGPELPGRPGCARAPDSVRCAPSMELAPEEPVTFSRTLTVPAPTSVTPTVWVRPRQGPKLADLITEPNTTVAHGDSDTVDVLGSAYAATDGDPATAWTAPQRVVQHKTPPTLTLTLPRPTQVAGVRLVPSRAALPAHPTMVAVNLGDGPQVTAVKPGQAQTIPLKPRVTDTVTISLLDWEDVIDRNALGFDQLKPPGLAEVAALGADGNPIGPADAGRNRAREVSVGCERGPVIAVAGRFVHTAIHTTVGALLDDQPVAAVPCERDPIALPAGQQELLISPGAQFVVDGAELSTPAAAEAAQPVRVASWRGWGPDRREIAAGPSNTSRILVIPESINPGWVARTGSGARLTPIAVNGWQQGWLVPAGDPGVITLSFASNSLYRAGLAVGLALLPVLALLACWRTRKRGTHDPPARPWRPGVWAAVPALAAGAVIAGAAGVAVLGAALGLRYALGARRWARLGMAGSAGGLILAGAALSRQPWRSVDGYAGHAGYVQLLALISLAALTASVVAVPRRRGGARHE

SEQ ID NO: 5132 - protein, 90 aa, Mycobacterium paratuberculosis
VRGGTSDDRFHVGRGQRRGGAVHRGGEHRRHHLGRHQPRRPPRAAGQRPGTPARALSGGIRRPLLPQALPALVTGAGDSADRRSARLALG

SEQ ID NO: 5133 - protein, 388 aa, Mycobacterium paratuberculosis
MALSRPLAAHAAVLAAVSELMIGCAHRAAPPPAHSSTSNTPAAAPAPRVCVDPPAAPATLNLRDKLAQLLMVGVKNADDARNVVNGYHVGGIFIGSWTDLTIFRGPLGDIAAKAGPLPLAVSVDEEGGRVSRLKSLIGTSPSPRELAQTQTVQQVHDLAADRGKKMRDLGITVDFAPVVDVSDEPDDAVIGNRSFGADPAKVTEYAGAYAQGLRDAGLLPVLKHFPGHGHGSGDSHTGGVVTPPLDDLQNDDLVPYRTLVTTPPVGVMVGHLQVPGLTGDVPASLSPEAVQLLRNGVGYKGPPFTGPVFSDDLSSMAAISDRYGVSEAVLRSLLAGVDVALWVTTDEVPAVLDRLQKAVASGELPAQRVDESLVRVATMKGRGPACGH

SEQ ID NO: 5134 - protein, 215 aa, Mycobacterium paratuberculosis
MAGGTKRLPRAVREQQMLDAAVQMFSVNGYHETSMDAIAAQAQISKPMLYLYYGSKEDLFGACLNRELGRFIDAVRADIDFQQSPNDMLRNTIASFMRYIDANRASWIVMYTQATSSQAFAHMVREGREQIIELVAGLMRAGSRTPRTDREHEMMAVALVGAGEAVANRLSTGDIDVDEAAALMIDLFWYGLKGSPEEREAAAAQPEADRSGAGG

SEQ ID NO: 5135 - protein, 420 aa, Mycobacterium paratuberculosis
VARMPAPRSDRNALDFFCAVIIVGVLAGIAGVATTLVLRVVQHATYHYSFGALLAGVAASSPIRRVLGPMVGAALAGLGWWLLRRRTDVPPLAETIARSERVPRLAWSIDAVLQVLLVGSGASLGREGAPRQFASALGDFGIGWLRRLSSRDREILLACAAGAGLGAVYAVPLAGALFAVRILLRTWRLRAVGAAFLSSGVAVAVGSAVTGDQPNLRWPVEESTYLLTAHGLLLAPVALAVGLVFNRLMAVARPARPMRTWTLIPALAGAGLVTGVCSHWWPELPGNGRSILTVSLASGMTLASALAILLLKPVLTALFLRAGGAGGLLTPSLATGAAAGAALVLTINWATASQLHVPAVSLAGAAGVLAVTQGSPIWAAIFVWELARPPLWLFLLFLLTATAAHGLKVLAQGRTTTHAG

SEQ ID NO: 5136 - protein, 280 aa, Mycobacterium paratuberculosis
MNQPSGLKNMLRAAAGALPVVSRGSALPTRTVTVEDLPIDRTNVAEYAAVTGLRYRNHVPLTYPFALTFPALMSLVTGFDFPFAAMGSVHTENHITQYRPIAVTDTVGVRVHAENLREHRKGLLVDLVTDVSVGNDTAWHQVTTFLHQQRTSLSDQPKPPPQKQPKLPPPPTVLRITPGLIRRYAVVGGDHNPIHTNPIAAKLFGFPTVIAHGMFSAAAVLANIEAAIPDAVRYSVRFGKPVVLPATTGLYIDEHDGGWDIALRNIAKGYPHLTGTVRAL

SEQ ID NO: 5137 - protein, 454 aa, Mycobacterium paratuberculosis
VAPKVSSDLFSQIVNSGPGSFLAKQLGVPQPETLRRYRPGDPPLAGSLLIGGEGRVVEPLRAALAKDYDLVGNNLGGRWADRFGGLVFDATGITTPEGLKGLYEFFTPLLRNLGHCARVVVVGTTPDAAAGPHERIAQRALEGFTRSLGKELRNGSTVALVYLSPAAKPAATGLESTMRFILSAKSAYVDGQVFYVGEADSTPPADWERPLDGKVAIVTGAARGIGATIAEVFARDGARVVAIDVESAAETLAETASRVGGTALWLDVTAPDAVDKITEHLREHHGGHADILVNNAGITRDKLLANMDDARWDAVLAVNLLAPLRLTEGLVGNGSIGEGGRIVGLSSMAGIAGNRGQTNYATTKAGMIGLTQALAPELYDKGITINAVAPGFIETQMTAAIPLATREVGRRMNSLLQGGQPVDVAETIAYFASPASNAVTGNVIRVCGQAMLGA

SEQ ID NO: 5138 - protein, 448 aa, Mycobacterium paratuberculosis
VAPASSEASKPAAQRSAQRRPVAVLGGNRIPFARSDGAYAEASNQDMLTAALEGLVDRFGLAGERLGVVVGGAVLKHSRDFNLTRECVLGSQLSSYTPAFDLQQACGTGLQAAMAAAEGIAAGRYDVAAAGGVDTTSDAPIGLGDNLRRTLLKLRRAKSNVQRLKLVGTLPATLGVEIPVNSEPRTGLSMGEHQAITAKQMGITRVAQDELAAASHRNMAAAYDRGFFDDLVTPFLGLYRDDNLRPDSSPEKLAKLRPVFGVKAGDATMTAGNSTPLTDGASVALLGTEEWAAAHSLTPLAYLVDAETAAVDYVNGRDGLLMAPTYAVPRLLARNGLSLQDFDFYEIHEAFASVVLAHLQAWESEDYCKERLGLDAALGSIDRSKLNVNGSSLAAGHPFAATGGRILAQAAKQVAQRKAELKGADKPVRALISICAAGGQGVAAILEA

SEQ ID NO: 5139 - protein, 611 aa, Mycobacterium paratuberculosis
VSHYKSNVRDQEFNLFEVLGVDKALGQGEFSDLDADTAREMLNEISRLAEGPIADSFVEGDRNPPVFDPKTHSVTLPESFKKSVHAVIEAGWDKVGIDEALGGVAMPKALLWALHEHILGANPAVWMYAGGAGFANILYHLGTDEQKKWAVMAAERGWGSTMVLTEPDAGSDVGAGRTKAVKQDDGSWHIDGVKRFITSADSDDLFENIFHLVLARPEGAGPGTKGLSLFFVPKFLFDFETGELGERNGVFVTNVEHKMGLKVSATCELSFGQHDVPAKGWLVGEVHNGIAQMFEVIEQARMMVGTKAIATLSTGYLNALEYAKSRVQGADMTQMTDKTAPRVTITHHPDVRRSLMTQKAYAEGLRALYLFTSTYQDAAVAEALYGVDAELAVKVNDLMLPVVKGVGSEQAYAKLTESLQTFGGSGFLQDYPIEQYIRDSKIDSLYEGTTAIQAQDFFFRKIVRDKGVALAHVSEQIQKFVDSESGNGRLKSERELLAKALADVQGMATALTGYLMAAQEDVTSLYKVGLGSVRFLMSVGDLIIGWLLQRQAAVAVAALDAGASGEDRSFYEGKIAVASFFAKNFLPMLTSTREVIETLDNDIMELDEAAF

SEQ ID NO: 5140 - protein, 357 aa, Mycobacterium paratuberculosis
VCNPSTCGDGGEVSNEMCPVPGVTAVPEVDLRADSDVLRDGLREAAHRVGFFYLTGHGVPADLVDRVLDAARRFFRLPQADKDAVAMVRSPHFRGYTRLGGERTRGAVDWREQIDIGPQRPPIGGLDKSDYRWLQGPNQWPAALPELPGLIEEWDAALSGVARTLLRHWAAALGSPADVFDAAFADAPATLIKIIRYPGRAAGPQGVGAHRDAGVLTLLLAEPGSRGLQVCRAGPGGDGWIDVPPRHGAFIVNIGELLEAATRGYLRATEHRVNLAGSTAERISVPYFFNPRLDARIPVLSLPPELRARAVERWTPSEDPADPIFSVYGRNAWKSRLRSHPDVASAHAFSAHHGAAD

SEQ ID NO: 5141 - protein, 162 aa, Mycobacterium paratuberculosis
VNSNNKLTASSLREAFGHFPSGVVAIAAEVNGTLEGLAASTFVPVSLDPPLVSFCVQNTSTTWPKLKDRPMLGISVLGEEHDEAARTLAAKTGDRFAGLETVSRPTGAVFIKGTALWLESAVEQLIPAGDHTIVVLRVNEVTVDANVVPIVFHRSGFRRLGA

SEQ ID NO: 5142 - protein, 248 aa, Mycobacterium paratuberculosis
MTYNATMRVWRGDDANGALQDFTVEVNEGEVVLDIIHRLQQTQTPDLAVRWNCKAGKCGSCSAEINGYPRLLCMTRMSTFAEDEVVTVTPLRTFPVIRDLVTDVSFNYEKAREIPSFAPPKDLQPGEYRMAQEDVQRSQEFRKCIECFLCQNVCHVVRDHEENKKAFAGPRFLMRIAELEMHPLDTRDRRKDAQEEHGLGYCNITKCCTEVCPENIKITDNALIPMKERVADRKYDPVVWLGNKLFRR

SEQ ID NO: 5143 - protein, 647 aa, Mycobacterium paratuberculosis
MVEVERHAYDVVVIGAGGAGLRAVIEARERGLRVAVVCKSLFGKAHTVMAEGGCAASMGNTNPKDNWKTHFGDTMRGGKFLNNWRMAELHAKEAPDRVWELETYGALFDRLKDGKISQRNFGGHTYPRLAHVGDRTGLELIRTMQQKIVSLQQEDYAELGDYEARIKVFAECTITELLKDGDAIAGAFGYWRESGQFVLFEAPAVVLATGGIGKSFKVTSNSWEYTGDGHALALRAGASLINMEFVQFHPTGMVWPPSVKGILVTEGVRGDGGVLKNSEGKRFMFDYIPPVFKGQYAETEQEADQWLKDNDSARRTPDLLPRDEVARAINSEVKAGRGSPHGGVFLDIASRLTPAEINRRLPSMYHQFKELAGVDITKEPMEVGPTCHYVMGGVEVDADTGAATVPGLFAAGECSGGMHGSNRLGGNSLSDLLVFGRRAGLGAADYVRALSSRPTIGESAVEAAAKRALSPFEAPAGGGPGENPYTLQLELQQSMNDLVGIIRNADEISEALARLDKLRERFKNLHVEGQRRYNPGWNLAIDLRNMLLVSECVAKAALQRTESRGGHTRDDHPSMDSSWRKLLLVCEAVAEPGDVEAAVIPDITITKKEQTPMRPDLLELFDIAELEKYYTDEELAGHPGRTPRTEK

SEQ ID NO: 5144 - protein, 275 aa, Mycobacterium paratuberculosis
MSAPTANRPASGVFSPTRARIEQRTLRTDRWWMSPLRIDLGFAAFLIYATARAFQQNYFFVGKYHYLTPFYSPCVSKGCGEAGDIWPQFLPDVWWLPYAAVSLPFLLLFRLTCYYYRGAYYRTVWQSPTACAVAEPRVHYTGETRFPLIIQNTHRYFFYIAFLISVINSYDAIVAFHSDTGPGGFGFGLGNLILLGNVIMLWVYTLSCHSCRHVTGGRLKHFSKHPVRYWIWTQVSHINTRHKLYAWITLGTLMLTDFYIALVASGTIPDLRFVG

SEQ ID NO: 5145 - protein, 104 aa, Mycobacterium paratuberculosis
LTSTPGTTGTTEFAELHDLIGGLRRCVSSLRARYGDSPAMRRIVIDADRILSDVDLLDTDVSELDLARATVQQSGEKVVIPDTQYDSEFWRDVDDEGVGGHHRS

SEQ ID NO: 5146 - protein, 146 aa, Mycobacterium paratuberculosis
MSNLALWTRPAWDTDRWLRDFFGPAAAADWNKPATSAFKPAAEIVKDGDDAIVRVELPGVDVDQDVQVELDRGRLVIRGEHRDEHAEEKDGRTLREIRYGSFHRSFQLPGHVTDDDITASYDAGVLTVRVTGAYAGNQAKRIAITK

SEQ ID NO: 5147 - protein, 855 aa, Mycobacterium paratuberculosis
MSADGISRDGCAPRHIIVVGHGMVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPACHVYRTLDDLDAIRADAQRAAQTAHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPWVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 5148 - protein, 99 aa, Mycobacterium paratuberculosis
VSGCCSTTVSQAALFRLDDGTVRAVGNVDPFSGAAVLSRGIVGDRNGCPTVQSPILKQAFSLEDGICLDDPSVSVPVYPVRITADSYVQVGRDYQPRAA

SEQ ID NO: 5149 - protein, 150 aa, Mycobacterium paratuberculosis
MPRREEPSHGLLDPVAKMLRLPFGTPEFIDRIVTGGVNQVGRRTLRMLITTWDAAGGGPFAASAIASTGMAKTAEIVQGMFIGPVFGPLLRILGADKVAVRASLCASQLVGLGIMRYGIRSEPLHSMSVDAIVDAIGPTMQRYLVGDITR

SEQ ID NO: 5150 - protein, 257 aa, Mycobacterium paratuberculosis
MALILVAHGTRRPGGVAMIEGLAAQVSTLVGGRVEVAFVDVVGPTPSEVLAAARAAGRPAIVVPAFLSRGYHVRADLPAHVALSGHPNVTVTPALGPSGQIARIVGDQLLECGWRPNDSVVLAAAGTSDDKARADLHTAATWLSALTGSRVTLGFAATGDPPLGEAVARARPHARRNGGRVVVASYLLADGLFQQRLHGCGADLVSAPLSTHPGLARLIANRFRRALPPVLAATARHASRRTGPHQRAHAPATRPVP

SEQ ID NO: 5151 - protein, 383 aa, Mycobacterium paratuberculosis
LAPPDSAPLTGYRIAVTSANRAEELCALLRRNGAEVTSAAAINIIALPEDQELHRHTEAVIAQPPDILVAHTGIGFRGWVAAADGWGLAPQLLSALSQARIVARGPKATGALRAAGLHEEWSPKSESSREVLRYLLDSGVAGKRIAVQLHGAADGWDPFPEFINGLRSAGAQVMPIHVYRWKPTPAGGEFDQLVASVARRQFDAVTFTSAPAGAALLERSRELGIEDQLLQALRSDVHAMCVGPVTAQPLIRAGVPTSSPERMRLGALARHIAQELPPLRSCTLRAAGHQIEIRGTCVLVDGAVKSLSGSAMATLRALAARPGDVVARNDLLRVLPGNSNDPHAVDTAVLRLRTALGDKNIIATVVKRGYRLAIDTPDGSAWH

SEQ ID NO: 5152 - protein, 463 aa, Mycobacterium paratuberculosis
MGRDHRITDWNPEDAAAWEAGNKRIARRNLLCTIAGDHVAFSIWTLWPVMALFMPAAVYGFSAGDKLLLGAVATLVGGCARIPYTLGIAAFGGRKWTTFSAVVLLIPTVGTIVLLANPGLPLWLFVLCAALTGLGGGNYAASLANVNAFYPQRLKGAAMAVNAGVANLGVAVIQLVGLLVLATAGHQAPYWVCAVYLVFLAAVAIAAAMFMDDINHGTQLSTMRSILFERDTHVISLLYIATFGSWIGFSFAFGQVMQVNFLENGESAKHAALHAAQLAFIGPLLGSVARIYGGRLADRVGGSRVTLGVLAAMTLAAGLLVIVSTVDDQHAGAHSVSMIGYVVGFMVLFILSGMGNGSVFKLIPSVYEARSRGRDTSEDERRQWARAMSGSLIGICSAVGAFGGVAINLALHQSYLSTGTETSAYWMFMASYVVAAIMTWLVYVRRPVAAPGVSLPETQAARL

SEQ ID NO: 5153 - protein, 303 aa, Mycobacterium paratuberculosis
VPFLEILRTGPLAVVEDLGRPGLAHLGVSRSGAADRRAHKLANRLVANPDDRATVEVTFGGFAARVRGGDVDIAVTGADADPTVDGIEFGSNSIQHVRDGQVIALGTPRAGLRSYLAVRGGICVDPVLGSRSYDVMSAIGPAPLRAGDRLPIGEHTQDYPELDQAPVAAITGHLMELQVVPGPRDDWLVNPDALVHTIWMASDRSDRVGMRLEGRPLQHRYPDRQLPSEGTTRGAIQVPPNGLPVILGPDHPVTGGYPVVGVVTDEDVDKIAQVRPGQYVRLHWARPRALAGAHAGAASWPFA

SEQ ID NO: 5154 - protein, 224 aa, Mycobacterium paratuberculosis
MSVTDLSGDLAHHLPTALVGNAVLDYGDRALMVQCGSTAEVLAWAQALRAAALPGVVDIVPAARTVLVKLDDPGRQRLLRQRLRKMNVTAASTPPAERHADVVIDVVYDGPDLAEVAEHTGLTIPQLIDAHTGTPWQVGFSGFAPGFAYLVDGDPRLRVPRRAEPRTAVPAGSVALAGEFSAIYPRRSPGGWQLIGHTDAVLWDLQRPNPALLTQGMWVQFRAV

SEQ ID NO: 5155 - protein, 335 aa, Mycobacterium paratuberculosis
MRQGWNRRGFLQLAGAAGVAATAGAAGLSAGCSAHQPPPGGAGPGSVTVTHLFGQTVVKEPPKRVVSAGYTEQDDLLAVGVVPIAVTNWFGDQPFAVWPWAADKLGGAQPTVLNLDNGIPVDQIAGLKPDLIVAINAGLDADTYQKLSAIAPTVAQSDGDAFFEPWKEQAAAVGQAVFAAEKMKSLVAGVDQKFTDIGKKNPQWTGKKALLMHGALWQGTVVATMAGWRTDFLNQMGLVIADSIKPFGTDQRAVIPRDHIKSVLESADVVIWTTQNPDDQKALLADPEVAGSLTTAQNRHIFTTKDQAGAIAFASPLSYPVIADQLPPQLTKILG

SEQ ID NO: 5156 - protein, 200 aa, Mycobacterium paratuberculosis
MRENRPMPASEAPPGLRERKKIKTRQAIRREAFRLIEQNGYAATTVEQIAEAADVSPSTFFRYFGSKESLLLADDLDPLILDALKAQPRELSLPQAFRRAYATVLSQLPDDQLEFESTRQRLMFSIPELKAAMYDEYYRTVTVAAEAIAHRIGRAADDFEVRVFAGALTGAMMAAFDSAPTTPETIYRALDFMDAGMPLD

SEQ ID NO: 5157 - protein, 463 aa, Mycobacterium paratuberculosis
MTTTITPVPQPAAAPERHKGRHWIDDWRPEDPEFWETTGKAIARRNLIFSIFAEHVGFSVWMLWSIVVVHMTAGPHGHPSASGWALTASQALCLVAVPSGVGAFLRLPYTFAVPVFGGRNWTTISAALLLIPCLLLAWAVSHPGIPFGVLVAIAATAGFGGGNFASSMANISFFYPEKDKGWALGLNAAGGNIGVAMVQKVIPPVVIAGGGVALSRAGLFYVPLAVVAAVCAFLFMNNLTEIKADVKPVWQSLRHADTWIMSLLYIGTFGSFIGYSAAFPTLLKTVFGRGDIALAWAFLGAAIGSVIRPLGGKLADRVGGARITAASFVMLAVGAAAALWSVKAVNLPAFFASFMFLFVATGIGNGSTYRMISRIFKIKGELAGGDPDTMVTMRRQAAGALGVISAVGAFGGFIVPLAYAWSKSQFGSIEPALRFYVVFFLGLLAVTWYCYLRKHNAITRVGI

SEQ ID NO: 5158 - protein, 426 aa, Mycobacterium paratuberculosis
MNHMTRPVSLEVAGRRVTITHPDKVVFPRAGGGETTGSAAGPHTKLDLVRYYLSVADGALRGVAGRPMILKRFVKGITQEAVFQKRAPANRPDWVDVAELRYARGTSAAEAVIHDAAGLAWLINLGCVDLNPHPVLADDLDHPDELRVDLDPMPGVSWRRIVDVALVAREVLEDYGLTPWPKTSGSRGFPIYARIARRWEFRQVRLAAQTVAREVERRAPEAATSRWWKEEREGVFVDFNQNAKDRTVASAYSVRATPDARVSTPLRWDEVAGCRPEAFTIDTVPARLAEIGDPWAGMDDAVGDLDRLLVLAEELGPPERAPKGAGTRSGGRRRSSMPLIEVARTKTRDEAMAALDVWRDRHPEAAARLQPADVLVDGMRGPSSIWYRIRINLQHIPEDQRPPQEELIADYSPWQGYGGRQKPSWG

SEQ ID NO: 5159 - protein, 561 aa, Mycobacterium paratuberculosis
MPNLLGLPGQATKAVAKVQQYVERGSAELHYLRRIIESGAFRLEPPQNYAAMAADIYKWGEFGMLPSLNARRTPGRAAVIDEEGELSYAELDRAAHAVANGLIAKGVKAGDGVAILARNHRWFLIANYGAARVGARIILLNSEFSGPQIKEVSEREGAKVIIYDDEYTKAVSKAEPPLGKLRALGTNPDADEPSGSTDETLAELIEHSSSEPAPKADRHASIIILTSGTTGTPKGANRSTPPTLAPVGGILSHVPFKAGEVTSLPSPMFHALGYLHATIAMFLGSTLVLRRKFKPPLVLQDIEKYRPTAMVVVPVMLSRILDTLEKMDKKPDLSSLRIVFVSGSQLGAELAARALKDIGPVIYNMYGSTEIAFATIAGPKDLERNAATVGPVVKGVKVKIFDDNGKELPQGEVVRIFVGNTFPFAGYTGGGNKQIIDGLLSSGDVGYFDEHGLLYVSGRDDEMIVSGGENVFPAEVEDLISGHPDVVEATAIGVEDKEWGHRLRAFVVKKEGADLDEDTIKHYVRDHLARYKVPREVIFLDELPRNPTGKILKRELREMEV

SEQ ID NO: 5160 - protein, 128 aa, Mycobacterium paratuberculosis
LMARVIWAVSLGSTSSWSISAVSTSCPVTRATPSRSAASRCQMSRARWVAAGRSTVRRVRWVRPAWLAGGALGTRGPPGWRMLVRRSVGAASPEGPAAWVGARNAPPLGPLWLGLKFTAVSSSVSANQ

SEQ ID NO: 5161 - protein, 79 aa, Mycobacterium paratuberculosis
PTTVAPATVAPRAMSPTIMASPSAATGTVGNGARSAVRPGTGETCGRRRRGGGLSRRGAAEQQRADHGPSRRDTRDDTV

SEQ ID NO: 5162 - protein, 733 aa, Mycobacterium paratuberculosis
MPIAINPEHQELADSVRALVARIAPSETLHEAMETEVGNPPPYWQAAAEQGLQGVHLAESVGGQGFGVLELAIVLAEFGYGAVPGPFVPSAIASALISAHDPDAKALAGLASGAEIAAYGLNCCALTATRQGSSLVIRGELRAVPAAAQASLLVLPVAIDSGEAWVVLRADQLEIEPVKSLDPLRPIADVRANAVEVGDDVVLTNLSMGTAHALMTTLLSAEAIGVARWATDTASSYAKIREQFGRPIGQFQAIKHKCAEMIADTERATAAVWDAARAIDEARENRWDTAGSHVEFAAAVAATLAPAAAQRCAQDCIQVHGGIGFTWEHDTNVYYRRALMLAASFGRSSDYPQKVVDTATTTGMRAVDIDLDPETEKLRAEIRAEVAALKEIEREQRKVAIAEGGWVLPYLPKPWGRAAGPVEQIIIAQEFASGRVKRPQTGIATWIVPSIVAFGTEEQKQRFLPPTFRGEMIWCQLFSEPGAGSDLAGLSTKATRTDGGWRITGQKIWTTAAQFSQWGALLARTDPSAPKHSGITYFLLDMKSEGVDVKPLRELTGNAMFNTVYIDDVFVPDECVLGEVNRGWEVSRNTLTAERVSIGSSEANFLATLSQFVEFVRDGQFDQVAQHRAGQLIAEGHAAKVLNLRSTLLTLAGGDAMPSAAISKLLSMRTGQGYAEFAVSSFGTDAAIGDTDQLPGKWGEYLLASRATTIYGGTSEVQLNIIAERLLGLPRDP

SEQ ID NO: 5163 - protein, 376 aa, Mycobacterium paratuberculosis
LTRRTGAGVIREFVGLPSPTAGRAGAGGHPCQGLYHRRVGRKPKVAMIAAHYQIDFSEHYLADYMATRGIGFLGWNTRFRGFESSFLLDHALVDIGVGVRWLREVQGVDTVVLLGNSGGGSLMAAYQSQAVEPNVTPLEGMRPAAGVTELPQADGYVATAAHPGRPEVLTAWMDAAVVDENDPVATDADLDLFNGRNGPPYTPEFLARYRSAQVARNHAITDWAERELKRVRAAGFSDRPFSVMRTWADPRMVDPGIEPTKRQPNMCYAGVPAKANRSAHGIAAACTLRNWLGMWSLRVAQTRAEPHLARVRCPALVINADADTGVFPSDAQRIFDALAGADKTRASVDTDHYFTTPGARSEQADIVAGWIGKRWR

SEQ ID NO: 5164 - protein, 223 aa, Mycobacterium paratuberculosis
LAQGGAQVSTAASPADRSGPPAELPTHRGRRTQAAIDLAARTVIARKGVLAATIADIAAEAGRSAASFYNYYESKEAMVRQWALRFRDEANQRALSVTQHGLTDRERAYGAAAAHWHTYRNRLAEVISVSQLTMINDDFAQYWAEICSIPISFIAESVRRAQAEGRCRDDDPQLIAEAIVAMFNQFCYVQLGSARCGEPDDEACIQTLANIYYRAIYATEGDR

SEQ ID NO: 5165 - protein, 207 aa, Mycobacterium paratuberculosis
LARLIEPGTEGSRTMIKPHNTNAEFELGGINHVALVCSDMAKTVDFYSNILGMPLIKSLDLPGGAGQHFFFDAGNGDCVAFFWFADAPDRLPGISSPGAIPGIGDITSAVSTMNHLAFHVPAEKFDAYRQRLKDKGVRVGPVLNHDESPMQVSATVHPGVYVRSFYFQDPDGITLEFACWVKEFESGDAKAVPKTAADRRPPVGAGR

SEQ ID NO: 5166 - protein, 182 aa, Mycobacterium paratuberculosis
MTDGILTDEQIAALTPGQRRDLISRLERPLGEVIDPDFLDRVRRVRLSLMIGGSIAMVPWLGYLAMTLPEKYVAHNWPVTWIGFDVLLVAFMLTTAALGYLRRQLLVLAAFTTGVLLICDAWFDLMTAGPKDVWLSVITALLIEVPLAIFMIFSAMRILRLTMMRLWLLRPGMRLWELPLFP

SEQ ID NO: 5167 - protein, 545 aa, Mycobacterium paratuberculosis
MTGGVVHQHRRKSVGQFQARHTSTILEKPSANRTSSTPRPPRKRRRLTAQGLEEMVALGNINEWHPPHGPVTMWMAAPAAREAARAARRSDLAPSYQQNQHLWASYQGKAMNRQLPRLMIVAWDIPGTCDIAAMTATINAHVRRQDTYHNWFEYDNGTFVRRVIDDPEAIEFVPVALGHKTADQVRAHALTTTPDTLEWGCFTYGIVQHADYFTFYASVDHLHIDGLSAALIFLDVHLTYQELAQTGHQPAGLPEIRSYRDYVARQREKAATLTLSSPEIKDWIEFARDTDGDWPSFPLPLGDTWSSTRGDLLTVELINAEDTESFDAACVAADARFIGGVLACTGLAEHELTGKKTYHGFTAKDTRTPGVDSMTVGWFASLIPITVPTAGETFAQAARTAQKSFDDAQRLADVPVERVLELATPDELGIKLPTQLPMMLSFLDFRKIPLNGLWAETKFGTYGDSLSHGGVNMWINRQAANTTVTMSFPDNVIARESVLRYIATLIQVFARVARPTGDEPVVVAPQVKPDDTFAPAPDTDDHEAA

SEQ ID NO: 5168 - protein, 381 aa, Mycobacterium paratuberculosis
VLPLGDRRAAAGARGHRRVARRADPQAAGRRARARMALGDAPADRRRRGGEPGHHALPHRWRRAVRGPGRRGSGTRRPDPLARRGRSAALASPARGRAPNRARRARCRPRRRCRGPDAPAGPRRHRVRRPATREAARAAGRARRPHCPADGDDLRQRRRLGRARNRLGRHQQRAARRVGGPPRPAGGAGGPRRLGQHRHARQRARPKRHARQRGHERRRHAGVRGDHHGPARDPRRHQAGAGSPSRRARRAVGAAAPRPADPEAGVSAVAQRGHRRRGDRGVVQSRRARPGRQPAGRHGRRLLRHEVGVPGRDRRDDAPHQRGPGVAVGAGPRPGLHLGPRLRIGPPQFERGSATSAFQDAERLLAGRHNGLAHGLPRVRR

SEQ ID NO: 5169 - protein, 217 aa, Mycobacterium paratuberculosis
MSDTSSARPYRGVEAAERLATRRNRLLAAGLDLLGDQRPDISAVTVRGVCRRAGLAARYFYESFTDKDEFVSCVFDWVVAELAATTQAAVATVPADEQTRAGIANIVRTITDDARVGRLLFSTQLADPVVVRKRAESSALFAMLSGQHVGNALQVPANDRIKAAAHFVVGGVGQTISAWLAGDVRLEPDELVDHLAALLDELAEPNLYRLTETRAEA

SEQ ID NO: 5170 - protein, 302 aa, Mycobacterium paratuberculosis
MAIHQSVQAPIGHVERGATDPPRPQRRRRGRTLGIDEGLMGVALLAGPANVIMQLAQPGVGYGVMESRVESGRVDLHPFKRARTTFTYLAVATNGSDAQKAAFRRAVNKAHAQVYSTPESPVSYNAFDPALQLWVGACLYKGGLDIYRMFIGELDGEDAERHYREGMALATTLQVPPKMWPADRAAFDRYWEESLAKVHIDDAVREYLYPIAANRIRGVKLPGPIQRLSEGFALMITTGFLPQRFRDEMRLPWDATKQRRFDRLIAVLATVNRYLPRFIRQFPFNVLLHDLDRRIKKGRPLV

SEQ ID NO: 5171 - protein, 518 aa, Mycobacterium paratuberculosis
MTAPIWMAFPPEVHSALLSSGPGPGPLLASAGAWNSLAAEYTSAAEELTAVVEGVQAGAWQGPSAESYVAAHAPYLAWLTQASADSAGAAARHEAAAAAYTAALAAMPTLGELAANHATHAALQATNFFGINTIPIAVNEADYARMWVQAATTMTTYQAVSTAAVAATPQTMPAPQIAKSTAATIPFQRPYPNPTNFSQVWADLWYDIPYSIETFQGPVDPANWTQLFQFWNVTFANLAGTPAKLAQIFSNPSVLFSWPTLLWVLDFIAGRIFDILVTLKFLLEQPLLYVVGLGMAVTSLGAAAGAAGGLVGLAGLASPGPLPTGAEMVPVTAPPPGATPAPTAPLIGGPASAPATIPVSSAAAAPTAPAPAPAVAAAGSAAPPPAGPGGFPYLVGGMRVSSAASASAQSRKPKSAAAAAARAAAAAAAETHHARRRLRVKAKMLGRGYEYMDLEDDHLSSSAASEHGAGPLGFTGTMRESGAATPAGLTALGGGSFGGGSKMPMLPTSWVTNGSGEA

SEQ ID NO: 5172 - protein, 342 aa, Mycobacterium paratuberculosis
LTLIKRCVRGNGWRTTLLMLLLLTAVAASLMVGRYPVGVGAMAGMLFGRLPLLDTSFTPVDQTVLTQIRLPRIGCGVLVGAGLAASGAGYQTMFRNPLVSPDILGVSAGAGFGGALALLLHAPYWQLEAMAFASGLLAAALALIIGRGIGRDSAILLVLAGMVIASVFGALISVTEYLANPDDTLPAIVFWLMGGLGRQHLDGLLAPALIIAAAVLVLYALRWPVTVVVSGDEDAHTLGVDTRRTWAAVVGVYTLITATTVSLAGIVGWAGLLIPHIARALVGPGFGRLLLVSAALGGVFVVGVDDVARAAASAEIPLGILSALIGAPFFLVVLAKMRRQWT

SEQ ID NO: 5173 - protein, 271 aa, Mycobacterium paratuberculosis
MDVSSAAIAAEQLSFGYPGDGQRLIAVSLAVQPGQVCCLLGPNGAGKTTLLRCLLGLLTPQSGTVRVAGDPIDRLSRRQLARRVAYVPQRSNTPFPFSTLDIAVTGRTPYLRAMTSPSATDRRAAAAVLDRLGIGALADRPYAVLSGGERRLALLSRAMVQDAPVLILDEPMAALDFGNESRILQVVAELAAAGRAVLMTTHQPWHALHSGDQAVLIADGRLIADGPVEQVVTAAALSELYGVPVRVLTATDDATGRPVYACAPVAAGDDR

SEQ ID NO: 5174 - protein, 345 aa, Mycobacterium paratuberculosis
MIRAVLAAVCVATSAAGCGAAHHSPAEPTRTVVDMTGQHVQIPATVTRVATNIPLIPATIELLGGIDTVVAAARGSFNALFTTIAPATQQIPRSPPTSLNAEQLLDLHPQVFFMTDLTPGLLPMLQRLQIPVVQITAFTSPQDLQKAVNLVAQVLGGAAPARARQYDTYFDAVIQQVHAGAQTDRPTVYYAPGPDPTTTVGADNIITASIEAAGGRNIAVEHGIGGHQPGAFAFPTITAETLLAWNPDVIVASNARVADQLATDPTFATLNAVRDHHIYTCPVGIFPWCASSSEAALAPLFLAKKLDPERFSDLNLANKVANFYIQFYGYSLTGPQVTAILDGAG

SEQ ID NO: 5175 - protein, 258 aa, Mycobacterium paratuberculosis
MPLSLRPAAALFGAEIGGIDLRAPLTREQRDELQRLLQRYRVLFFRGQQLSTAHQIEFAEAFGPILIFRSVVPADPQHPGVHNVDGSTVGWHLDASGLIEPPVASVLRAVEIPDRGGDTVWADGMAAYDGMPDDLKSRLEGLSATHTAPNQHPLVAHPLVSHHPDIGRRYLNINLAPWVDTRILGMSTSHSSALVEQLRAHHLRSDYQLRFRWSAGAVVLWDNRGMQHTGIRDYGDDTRRRLQRICIAHFTEGVTGRA

SEQ ID NO: 5176 - protein, 210 aa, Mycobacterium paratuberculosis
MTASPDDTNALAAEWDERYAGLTTEMRDAEPNAVLITEVSKFAPGRALDIGCGVGAEAIWLASREWDVTALDVSRVALARATARGRQAGVRVNWVRAALEDAPLRVGGYDLVTAFYPALRHSSGRAAEESLLAAVAPGGTLLVVHHADVDAEKAKSYGFDPADYLSHDDIATLLDGDWHVRVDRRQPRKTPARPELQHTHDDVLLARRLR

SEQ ID NO: 5177 - protein, 517 aa, Mycobacterium paratuberculosis
LHRQRTDRHHRAVAGETVIRIDGVRWQYAGTDAAVLDGVDLHIRRGETVLLCGASGSGKSSVLRLMNGLIPHFHQGSLDGSVHIDGTSVAELSLERVGRLTGTVLQHPRRQFFTAAVDTELAFTLENFGTPPEQIRNRVGSVITEYGLAELTGHRLAELSGGQQQQIACAAAATHGPPLLLFDEPTANLAADAIERFTATLARLRSLGTTIVIAEHRLHYLREIADRIVLLRNGRIAAEWSRKQFARLDDAALNAEGLRSNNSPVRNHIPPACAYGASVAGTPSGTAAPASSPSEVVLRGIRCCFRGHRVLDIEEARFPAATVTAITGPNGAGKSTLARVLVGLQRHDGEVSFGGSRISRSRRQRMSAIVMQDVQRQLFTESVRAELRLGAPPAAAGVASTLLRDLGLEEFADRHPLSLSGGQQQRLVVAAARLSNRKIMVFDEPSSGVDRRHLRSITNVMRDVAAQGVVVILISHDQELLTLAADQELRMRVADTLNARSRRKAAGENACLETLSD

SEQ ID NO: 5178 - protein, 237 aa, Mycobacterium paratuberculosis
LTRTTTRVTQLDPRTKTVLVLASSIAVMAPGGEVFVPAAVIVGMLLAVAEQAWVRAAILPSAAGATAAVAYLLPQAIPHPIIGAIGTVAAYLLRLIAVGAIVIHLVNTTTPSEFTAALRATHIPRAITVSGSVMLRFLPTIVGEARAVSDAMRLRGIGGTYGMLRHPVCTIEYFTVPLIASSLRVAEDLSATALLRGLGSAARPTTMYPPRFGKADALIGCIVSALTVTTVLWPVKP

SEQ ID NO: 5179 - protein, 208 aa, Mycobacterium paratuberculosis
MTATSSTTQSSRRIDVRMSARDLINIGVFGALYIATVFAINVFAFINPLVMLVALAVSMIAGGVPFMLFLTRVRHAGMVTVFAIITAGLLALTGHPPICFVITVACALVAEVVLWLGRYRSRTMGVLAYAIYAAWYIGPLLPIFYARDEYFSSPGMAQMGPRYLEEMERLLSPAVLIAFDLSTVVFGLIGGLLGVRLLRKHFQRAGLA

SEQ ID NO: 5180 - protein, 593 aa, Mycobacterium paratuberculosis
MSTMIRYLLELLDERGRRHLRVMLALQAAQGILQGLGFLFVVPLMGVLIHKPVDTHALWCWIVAIAVAVVAHHGLLAWSTSLGYLVGTDVLTSFHTRIGNHLATLPIGWFRTDRTGPIGRLLSKGTMDVADLPAHLLRHVIVGVAAPATMIIGSYVLDWRVGLAFTAGALLCALTLRLLMVVIHRNDDQYDHDIGVTASRIVEYARQQPTLRAYGVLNRPGLGTLEESLVRQQTSQSRLTIRGAWALIGFFGTVQLVVTAIIALTVALAVSGSLALSTMVGLLIITLRMIDPISQLGDLAGHVQVNADAIRRVRELLTVPPLPEPTHPGQATGADIELQGVRFAYDGGQPTIDGIDAVFPQGSLTAVVGPSGAGKSTLLKLIGRFFDVDEGSITIGGCDIRQLGTAGVSHLTAQVFQDVYLFEGTIADNLRMADPQATDDDLRHVATISRLDEVVDRLPNGWETRVGEAGSTLSGGEKQRVSIARALLKDAPVVLLDEATAALDAANETAVSDAIHELARDRTVIVVAHRLSTVAAADQILVLDGGRITERGRHDTLVGAGGTYARFWEERTRARGWQLRQIAPTPELQAPRP

SEQ ID NO: 5181 - protein, 473 aa, Mycobacterium paratuberculosis
LSRRPLKTTSAALHQLIAHSIVELTAATVPPLVALTYLFAVDWRMALVTLLPVLIGLVMYQRAMASADTKYPEFMQWLARLNSAAVEFVNGIGVVKAFGTPGVASRRFQEVSRAFAHFFLDWAKSTSVAAVIAETLLSPPSILVVVAGAGGALTANGKLPLDSFIAFLVFGTVITAGLMTVMMSIHPLVTALGVARDIRELLAGPELPTPDEPVGLDPSSAAPVVRLRDVVFTYGETVALSGINLELDRNTITALVGPSGSGKSTLAKLLPRFDDPVEGSVELYGVDLRSVDPAELYRHVAFVFQDAELLRMSIRDNIRLSRPDADDVAVRDAADRAQILERIEQLPRGFDSVVGEDAELSGGERQRVCIARAILADRPVLVLDEATASADPENEARIQDALNEAASGRTVLVIAHRLNTIRGADHIVVLDDGRIAEQGTHFELLESKGLYARLWEHDRRVQSGVAEHMEVGR

SEQ ID NO: 5182 - protein, 179 aa, Mycobacterium paratuberculosis
MLSITIFIIGSRWLGLSAEGLSMDPNTPSQVGPQSPVFGAARATLIGCALLTALSALAGMAPLIAVVEVSRRLLAGDTAVWAIIAAALVALAVKQLGTFCAGVLTHLADIQVSFRIRRDLLVKLSKLPLGWFTDRNSGIVKKTVEDDVSGPAPADRPFHRGTHRGDSSPISRLDLPVCC

SEQ ID NO: 5183 - protein, 504 aa, Mycobacterium paratuberculosis
MTAPVWMASPPEIHSALLSSGPGPGPLLEAAAAWSSLSAEYASAADELTATLAAVQAGPWEGPTTEAYVAAHAPYLAWLDQSSADAAGEAAQHEIAASAYTVALATMPTLPELATNHATHAALVATNFFGINTIPIALNEADYARMWVQAATTMSTYQTVSTSTLAAAPRSSAAPAIVKSEDSSAGDTGDSSGGGGFFGDLLSAWENFVMNLMDQLFGVDSPPDLASAVAAFLANPSPALFSALLFALAYEIAFDTLFFSPVALLAAPFLPFVGLAGLAGLAGLAGLAPAPEPVPATVADVPAPTSPPNQALPVAGIPSASTPASAPASAPATSATAPASAPAPAPASAGSPVFGYLVGGGGGGESGPTLTGRSNATAPAGLAAASAAAAKAPTRDQTRSRRRRRTVMRDHGDEFMDLDMGAPVDSPPGGTFVSGQGAGSLGFAGTVANAAGARAAGLATLDADGFGSSPKAPMLPGSWHGDATQESQGSGDDEHPTEGNAGTE

SEQ ID NO: 5184 - protein, 244 aa, Mycobacterium paratuberculosis
MSVTPGADPYALSAEFYEVMAIPHWDMKRQVLVSALTARGPVKDHVLDIGAGTGLSTVTVADTIADVPIHAVEPSAAMRAALVSRILSRPDLIDRVTVHPVNLEELDLPERLGAVVLFGVIGYMDKQARQHFWAALRPRLTPRAPVIVEVMALDQPMPVPEMTIAQQRIGVRHNEVRISGQPAGSDAEHWTMRYVVSEGDKVTREFTAEHTWHTVGLAELAHEAEAHDMTFEQLHPIIGVLHPR

SEQ ID NO: 5185 - protein, 516 aa, Mycobacterium paratuberculosis
LSIGAQMLDHARSNQTWTTAVAALACFLMTLDITVVNVALPSIQKDLGASLEGLQWVVNAYVLAFAALLLTVGSVSDRLGRKRLFLTGVAVFTVASALCVASRTESPLIAARALQGIGGALVFGTCLALIADAYTDAEEEQRRKAVGLAMAAGAAAATLGPLIGGGLVEIGTWQWIFAINVPVGVALAICTALKVREPHAPHAADNSRVDSVGAVVAIVVLFALNYGLLTGAAKGWGRGDVLAALAIGLAGGVGFVLHQLRRGSEATLDLTLFRIPTFLAAIVLGFTVRALSFGVFPFLILWLAGAHGRSAFDIGLILSALALPLMVCAVLSTSVARAVGVRATMSIAMVITAAGLFLATLIRGDGSWTTILPALAVLGVGNGVAMPHLMNLAVDVVPSNKAGMATGAANTAFPLGTATGVAAFGVVLSSFVHAKVAASGVIPVHSADSVASAIVAGVLRFPTQAMTAFATSAFTDALRLIFGIAGCAALVAAGLSGALITHRPRVAAESPESVTE

SEQ ID NO: 5186 - protein, 3068 aa, Mycobacterium paratuberculosis
LQDNRTVRRPAPKMMSSTPGPPALHDGDRSVPAVFAEWVGRRPDAVALRTVAATGIDDWTYQRLWDHVREIRDVAFSGLSAGIRIPMALPGGADYVAGMLAALAAGLIPVPVYLPSTREPQRFLARAQHILRDCEPSAVYTCGELVEVLERDPILGALPIRTPASTADGLAPHPGGTTADADHGEHVAFLQYSSGSTGKPKGVVNTHQSILRQAAFAANVWNGDDDMHMVSWLPLYHDMGIFWGVFMPLLNGGCTTLIPPHDFVRNPRIWLETVSRFRGNWIGGPDFAYRRCIEAFDGTALQSLDLSCLRLATNGAEPVRGTTLRDFTAKFRAAGLRDDVMAPQYGLAEAGLGVTGSQTVRVWVEKSFDADALERGIAVEVAQPNPADGRSRALVSCGDGAFGWDIQIVDPDRHMTLTDGEVGEIWVGGPGLPDGYWRQPEQTATTFGARTADGLGPYLRTGDAGFRYQGELYVCGRYRDLIIVGGRNHFPNDIEKTVEEAHCGVAPGGACAVQPDAPQANGEWWLVLETGSPVEDLDDLSRILRRRILAHHETAPERVVWVPCRTLPTTTSGKIRRRETLNRLTAGQLEVVHEVSPRAQAPDTPAAPDDPPTELAQHLAAMLGVEPYELAPDADLTTLGLTSMMTAQIVEWSSSQSRRLDFADLYAEPTLRSWQRLFDAAPPVQTGTSSVAASGPWPTTPLQQAYWVGRGAEQPLGGVGCQTYFELVGARVDAGRLAAALDALTRRHPMLRATFPDPGRCLITPEAVRLPLAVHDLTDAPVTTRDTHLAEIRRRLRTHRFDIETGDTWTVELTRLPHGCIVHFAVDLIIADVTSIGTMLRDLAASYRGEKLPAPSATFADLIQSTSPPPQACADRLPEGPQLPRVQEADISFLRHQHTLSALATKAIDDACHNHGVTRAAVLLAAYTLVLRRWASQDDFLVNVTTFGRSPEVSDVVGDFTETHLYRAQLDGQISFVDQAQVTQKGLRTALRAAPAPDLLATQLRSGTGHSGIVPVVFTYAADSPLLSAEDANTLGAIDEVVSMTPQVLIDHQACRLGDDVVLSWDYRAGCFPPGVVDDMFEAYVTLLERLGGHDWSTPATPGLSAHSRLARAHRNATTTPAPAGLLYDAFRENAATHPARLALRWRPDDYRGERHGDVIAQDRSQLTYGELDELARSVARAVAARHAAGSVIGIQLPKGPSQIVAVLGVMMAGCTYLPVGVDQPAERLSRICARSAMAGLIRTDSDTQDAGVAVSDITAMIECAPTDPIRIDPHDAAYVIYTSGSTGEPKGVLVSHAAALNTIVDVNRRNRIDTHDRLLALSALDFDLSVYDTFGALGCGAQLVTIPEHARRDAFHWLSLTTEFGITVWNSVPGLMDMLLIAAGDKAGSLPTLRSVFLSGDWIPLDLPRRLRRAAPGVRLVAMGGATEAAIWSNEFVVDDVDPDWASIPYGYPLANQMFRVVDDNGDDQPDYVAGELWIGGAGVALGYHNAPELTSDRFVHDPTGSRWYRTGDMGCYWRDGTLQFLGRADSQVKIRGHRVECGEIEHALRGHPLVAAATVVPIHNCTALGAGIVVTGSGAEQFDDSTPGALRAHLAVRLPQYMIPKVFVSCPELPLTANGKVDRGKIAARLEAAARAPQPLDTSSTLTVVERLVAEVWSDVLGAPITGREDNFFAQGGDSLRATEAVARLTRRGVAGAEVGQLLSHQTLGQFSAACVLADPASEASESAADVGEPVTPGEGFPLTRLQQAYTLGAAGLNGSTCAPTYFAVVLAAAPESAGIDLDRFARVVTRCVDEFAMLRCALDADTTQRVQVDAGPVPVHDLDIQDDPDLLLRRMAAAPFDPHSVPVIQCFAPSRSPRHVGLLISYLGLDARSLSTVVTTIIAEYQSQPRPRQVDPTAAVFARFASESAWGENDVDNSVAGPPLLPLHDQRRDPFERVTFARRSFTIEEQAAATLREHAAHLGVTPTALVFEAFAHALASIGAGQRFAVTVPKSYRPDYAPADREVLGNFTRLALCEVDYGAVRPGSAEAVAAAQRELWRAVSHDGDITGGLAATRTAGGYPVVFTSTLGLTHQDASGLTNVRTLTQTPGVWLDCQTEDEVAGIRMSWDIATNVVAAESISVAFSRFEEAVRRHAGQAEPPGTAVAPAVGGSPGPEWASAVIAAALRHCRPEQVLPQYTMLVRRWEALRYVPSGYAASDVERAARRLAGIVTGAVSPQTLIGDPQLTPEALLLRDDRMRMALDDLAGAIFGHARTLGRRLRVVEVGSRTGLITERLTELVGVVVEEYLCLEPNPTLAGIAAGRRFPAPTRHVDAPDAASGVDVVICCGSLHQLPDAEAVLEAITVSDDGWLWMVENSEATQATLISAAVLDPGLLASDSKTLRPADRWWRLIADHGWRPTHMIQDGPGLTLIAHRPDKPGMPTPPAEQRRDGRWSRPAVPASSLPTDATVVATLAEIWQRHLAIPTPGVDDDFFLLGGDSLVATRVYADLRAAGFGQLAFVDLFNHSTLGELAAHAGPRTGPEVSVAAESTRGGTHDPNRFPLTVVQNAYRAGREGALILGGVAAHCYFEFELADFDRPRFDSAARQLVARHAGLRTTVSPAGTDAASSGEVAVVHTAPIEPVVRDHDDVRAAMRDQIIDLTARPGIDFGVQTRGDGRTVVGISMDNTMLDGASMMIALSELDHLYRGETVDQLPPLETSFAHYVWNHPELLPDADEAVLPRLAASRDYWRARLPSLPPAPKLADMSLLFEIEEPRFERATATIPAVDWSQVTRSCRAEGVTVASFLLANYARVLSRWSGTDHFCINVTLFDRDPDVVGIENVVGDFTSLVLLECRVDEPASIWESVRALQRQLMTDLPHRGADAVWLQRELLRFHGNPTAALFPVVFTSGLGLVDASARAAVRFAEPVFAASQTPQTVLDFQVWESAGALKLSWDFVSQAVSPATARTQLESLVDGITGVATRSRRIEHKLGEGASNDELLQRVSRICASALGQPRVEPHDNFFQLGGDSVSATKVVEQIGRELSASATLRLLFANPVIGDFAAKIADTDNADEPDLTVEEGML

SEQ ID NO: 5187 - protein, 281 aa, Mycobacterium paratuberculosis
MTAAELVDHLRGIGVQLWADGENLRYRAPQQVLTADLKAQLAAVKTDVITLLAEETTLLRAPQDRFEPFPLTDVQAAYLVGRTSAFQWGGVGCHGYAEFAVDHTVATPSAEQYREAWRKVADRHDMLRCVVHPEGYQVICPDVPDDGLVIHQCHTVEDVAGVRAGVTEHLRNRIYPLGEAPMYDLVITMGPDDTVVHLSVDLLIADFVSISILMTDFQQCLLDPECDLAPVDFSFRDYLLNLARERSSAAGSARRERDLAYWRDRLDQLPSPLSLPVLPDD

SEQ ID NO: 5188 - protein, 1535 aa, Mycobacterium paratuberculosis
MRLSAERFEVLSRRAAEHGATVNVAIVTAFSRAIARYGDRDHFLLTLTTMDRHAFTPAVGQLVGDFTGTSVLEVDVRGQRTFAELLHGVGDRLFDDMDHSTTGGVNVARLLGQRDDDRGEQTPVVFTSTLGATTRIDSGATSLLHPIQGRGLSQTPQVLLDCQVAEIDGMLEVNWDTRDQAVPAEVLDRAFADFRHALDLLSTDASAWHRPLLPAQPPETTPVEGPRTHHEPALIHTGFLRNVLVTPDAVAIRHGDRATTYAELLAAATAVADTLAATGVRPRDYVGIRLPQGPAQIAALLGALLARAAYVPLDVGWPTHRVDQIAAQCSLAALCEPDGEVDRLLADPQTWSPRAAVVPEPHSEVLAPDDTAYVIFTSGSTGVPKGVMMAHGAVVNTLTDINDRLAIRASDSVLAVSQHTFDLSVYNIFGVLAAGGTIVFADGNETSNPQAWCDAITDHRVTVWNSVPAQMQLLLDHVNGTQTLPSLRNVMLSGDWIPVSQPPEIAALAPNASMLSLGGATEAAISSICHPLAAQVYQRSVPYGTAMRNQSVRVLTHRGEPASPWQIGEIHIGGLGLAQGYLGDPERTASAFVVHPVSGERLYRTGDYGRLIHDGVIEFLGRRDNQVKIHGHRIELAEVDSALSALAGVHAAVSTVVGQGPHDRLLAAVVVADAADDDEKRQRRDIAAAVRCAAADAHRNSTADLDGDKLGHFASTARAVAIESMCAALRTVMDVGERIDFAELAGRLALPQRLERLLRRWLDALEEAGMVVMHRGPSIELRGGPELSACSAQWQHVRALGAAVDYGDELLDYVGQCVENLSGLLAGTVDPLALLFPEGTLDTATAAYRDNLVSRYTNGLVIAGVAERARWATPTRPLRVLEVGAGVGGTSVGLVAALAHHHVRYTFTDVSHFFLGQAAKMFAEHDFIDYRLFDVNQPPAAQGLPPGSFDVVVCANVLHNAVNVDDTLAMFERLLAPGGSLVFIDATATNHPLMISMEFKEGLHGFTDARAGTNSAFLSYAQWGDALERSPFGEVWSFPPPEHPLSKLGQHVFWCDSASGAHALRPGELTERAHAVLPSYMVPQQVICLRSLPLTTNGKIDRAALTAELESLRAAARRFGRGGDGVSASLDAMQTRIAEVWVSVLGLPSTEALSPNSDFFALGGDSLLLAQTIGRIRREIDEAAGIAWDDLLRAMVSDPTLAAAAQAVQGCGPTADSGDYSAELDSPLVYLGAGQGFRSGTEIAVCVHDGSGGLAPYEQLVSELRSAADGAPELYGLRRVAGDAYSRIAPPELFTTLASRYGAAITALAPSKVHLVGYCMGGLLATEIAKCLEESGIVVAPVTVVSSYRVPFDIEDDDILDYCFAQIMGVSPSDLGLRVADDAIRAAFAAVRSRHADLIPPGALRAVAAPELASALDQSAAPGEQRLKLLAQSGVLGDSWTAESLTELRAIFVHSLRSVVQGAADPFLGDVHFLRQRGDIHFLPTLKEDMTEFWRGYCLGELTITEIDGNHFDCLTGENARSVAGLLLGSWVVRT

SEQ ID NO: 5189 - protein, 348 aa, Mycobacterium paratuberculosis
LGGAHVRKVLLLGSTGAVGSGCLDVLSRRDDLAIVIAGRDEARLRAVASTKRSGVEVTRLDIADVPAVTATAAHCDIVVNCAGPSYRFSSDVARAAVGAGAAYVDPGGDQTLLDSLAAIETTAPVVLQTGVQPGLSGLLLRALALRHPERIENMHAWCGGLQPLTAAAVHEYLASLESPHSYPASALRGGAVRRVRNEECVPAPAQYFPDTASVHPHLDSETIAVAAQLGIGKVWWANVLDGARTIRAIHLLAAEDRQGCRDKDLREVLAAVKLDLFGRAAYFAIVCAAQSDSVSTTLAVTCENSYRVSGALAAFAAQRVTRMTAGVHPFWTVDDPWDVLAFLAATVP

SEQ ID NO: 5190 - protein, 344 aa, Mycobacterium paratuberculosis
VTTRPHRPRAIVVGSTFGAVYAEALAAPESPVELVGLLSTGSRQSADLASRLAIPLYTGMNSLPRVDIAFVVVRSGVVGGEGTRVCKELLSRGVHVVQEQPVHADEIMSLLHVAAENAVLYTVNDFYSRVAPMRQFICAAKTLDSLARIRYVHARASLHVVYPLFTILASIVGPLTPARIVMPEQTGGAFVAGRIVLADVPVDLLIQNELCASEPDNYARLLHTLTVGSDAGELVLDHTHGPTRWHPRPYPDSWASQSGCPISERVGIDFDPTTATVRNELWPDAVRLAASEFLGSIGRVRAGVTQRFVRATRLWSEFTSAMGPAAPINPVTSARLSASELVAL

SEQ ID NO: 5191 - protein, 280 aa, Mycobacterium paratuberculosis
VVRIYVGDGACRTDQSGDIGKAFGLGAGCLMTVRIGALTEPTPGNRTVVVFPHAGASPRFYASWCRLLPAGVDLYGVTYPGRDMLLDEPVPETLADLACNCAVELKPIIYSSSSVVVFGHSMGSLVAFETIRELEQDGVSVTALVASGADAPHLETDQSWHRAADEDLIQHLAELDSRSRDVFAVPELRRMLLPTVREDFRLVESYRAELHPPVSCPIHVMTGDADPEVTAHRWAQWAVHTRAPWHVRSFAGDHFYIRTHEDDVVRHLCGILTSAPAATQ

SEQ ID NO: 5192 - protein, 104 aa, Mycobacterium paratuberculosis
MTRTPESQQESDYGYVAHKDGYAKRLRRVEGQIRGIAKMIEEDKYCIDVLTQISAANNALRSVALNLLDEHLDHCVSSALAEGGDEAQAKLSEASAAIARLVRS

SEQ ID NO: 5193 - protein, 406 aa, Mycobacterium paratuberculosis
MHTPVVLLTGRGCTGRVAAALRETPGTAVISHTLDGHVVRRRVSMLRAGAPWDSDWILELGNADPGRTIHDDLLILLRRVHRRQDVDRVVVLLDERTELELICYAINHTPVCVGPGYADGPAALDVHISSVVTCVDTDSWLAHAMGDDELDDHRSAAQAVVDQAEFADVLVLSKPERRTEAVLRRLAPRSRITCDITSIESILRNLHPLARRGADFDPHESLLTGQPPLVSEAGVSLLDFTATRPFHPARLHTAIDVLLEGVVRTRGRVWLASQPDTVVWIESAGMELRVGNVGRWLAAMDASEMAAADADRRIMAAARWDDQHGDRHVAMTILTCGADPGEILRILRWALLTDEEFSQPGRWANYADPFGDWRAGPFESVSYGSAGEHPDIIRGHGADDRIGDTS

SEQ ID NO: 5194 - protein, 402 aa, Mycobacterium paratuberculosis
MAAGRLWAGVDVGREYHWVCVVDDTGAVVLSRKLVNDEQPIRELVAEIDQLAEEVSWTVDLTTVYAALLLTALAAADTPVRYLSGRAVWQASAVYRGGEAKTDAKDARVIADQSRMRGADLPVLAPDDDLITELRMLTAHRTDLVADRTRTINRLRQQLVAVCPALERVAALTSDRGWVMLLSRYQRPKAIRNSGVSRLTKILGDAGVRNAASIADAAVTAAKTQTVRLPGEEVAAHLVAELAQGVIALDARITATDADIEGRFRRHPLAEVITSLPGIGFRLGAEFLAAVGDPARIGSADQLAAWAGLAPVPSDSGKRTGRLHTPQRYSRRLRPVMYMSALTAIRCDPQSRAYYQSKRDEGKQSIQATICPARRRTNVLYALIRDNRTWQPDSPPITESAA

SEQ ID NO: 5195 - protein, 286 aa, Mycobacterium paratuberculosis
MGRLAGKVALVTGGGRGQGRSHAVHLADEGADLIVVDIGEDIPSNQYALATRADLDDTAKLVEKAGRRVVAAQVDVRDRVGLKALLDEAVTQLGGLHVIVANAGICPLGNDIPVQGFVDAFDVDFIGVVNTVHSGLPHLNAGASIIVTGSVAGLVPQAGGVSGQGGLQGPGGDGYGLAKKVIRDYTRSLALTLGPQQIRVNAIHPTNVNTEMLHNPAMYQTFRPDLTNPSREDAEVTFPFMQAMPIPYIDPCDVSHAVVYLAADESRYVTGQQLFVDAGASLKLGM

SEQ ID NO: 5196 - protein, 154 aa, Mycobacterium paratuberculosis
LSEGDRVARIPVAKMVKKLWIVLVIVAVIAVAGLCVSRLRAAFANRDDRPISSGAADDIKPFNPKRVVYEVYGPPKTVADINYLDINAQPQKVANVALPWTLSVITTLPSMSVNVVAQADTDQIGCRIIVNEVVKDERSADGVRAQTFCIVKSA

SEQ ID NO: 5197 - protein, 985 aa, Mycobacterium paratuberculosis
LHSEVGMSIDHFGQPPKPQTFARAVRRFAVPVVVFWIGLVVGLSVFVPSLDKVAKLRSVGVSPSEAPSMQSMKRAGKVFHEFDSDSVTMIVLEGDHPLGDNAHHFYDQIVHMLEQDHKHIQHVQDFWGDPLTAAGSQSSDGKAAYVQVYLAGNQGESLANESVAAVRKTVGSVPAPPGIKAYVTGPAALLADQSSAGERGVQKVTMITFGVIIVMLLWVYRSIVTVLITLMMVGVELTAARGIIALLSYKNIIGLSTFAVNLLVLLAIAAGTDYAIFILGRYQEARGVGEDREKAYYTMFHGTAHVVLGSGLTIAGAMYCLSFTRLPYFQTLGVPCAVGMLVAVFAALTLGPAVLTVGSRFGLFDPKRRMRTRGWRRVGTAIVRWPGPVLAVSVAVALVGLLALPGYQTSYDNRPYLPTSTKANIGYDAAERHFPNARMNPELLLVETDHDMRNPAGMLVLDRIARGVFHLPGVARVQAITRPLGTPIEHTSIPFQISMQNTIQVENQEYMKQRMKDMLQQADAMQQTIDTMQRMYNITAQLVATTHHMTGLTHEMTDITKELRDNIENFDDFFRPIRSYFYWEKHCFDIPACWSLRSVFDTLDGIDLLSDKLTELSRDLDKLDVLMPQMLAQMPPMIAPMTTMKTMMLTMHSSMSSLYDQMDVMSQNSTAMGQAFDASKNDDSFYIPPEVFDNPDFKRGLKMFLSPDGHAARFIISHEGDPATPEGISHVDPIKNAAKEAIKGTPLEGAKIWLAGTAAVYKDMRDEAKYDLMIAGISAASLILIIMLIITRSLVAAIVIVGTVLLSLGASFGLSVLVWQDIIGFKLHWMVLAMSVILMLAVGSDYNLLLVSRFKEEIAAGIKTGIIRSMAGTGAVVTSAGLVFAATMASFVFSDLKVIGQVGTTIGLGLLFDTLIVRSFMMPSVAALMGRWFWWPQQVRTRPASQMLRPYGPRPAVRTLLLPENRDVAGSYVRVGKLSFSRPHY

SEQ ID NO: 5198 - protein, 578 aa, Mycobacterium paratuberculosis
VFGSSVQDVLRERAGMQPNDAAFTFVDYEHDWAGIAETLTWSQMYRRTLNVAHELRHCTSSGDRAVILAPQGLDHIAAFLGALEAGLIAVPLAPPAGGAHDERVHSVLHDTSPSVLLATSSVVGDVAKYAQPRSDGSGPSVIEIDSLDLQRSRVTFRRGNRPATAYLQYTSGSTRRPAGVMVSHKNLLANFRQIMSDYFLDYGKVAPPDTTTVSWLPFYHDLGLILGICAPILAGVRSVFTSPVAFLQRPARWMQLLANNSRVFSAAPNFAFDLAARKTTDEDMAGLDLRDVLIIQSGAERVQPASMRRFQDRFAKFNLRDTVIRPSYGLAEATVYVATRTPALPPRVVYFQPEILSSGHAKGCESGSGTALVSYGVPRSQTIRIVDPETSTECPPGTVGEIWVHGENVSAGYWQRPHETEKTFGARLIGPSAGTPQGPWLRTGDSGFFFDGELFIIGRMKDLLIVYGRNHSPDDIESTVQAIAPGRCAAVAVPAEGTEKVVVIVESKKRGGSDEEVMNNLAAVKRELTSAISNSHGLAVADVVLVAPGSIPITTSGKVRRATCVEQYKQDQFARLDV

SEQ ID NO: 5199 - protein, 450 aa, Mycobacterium paratuberculosis
VAHPGGAIPDNRLAFTDQMSFLSVRATGQGTVAQCVWIYERTVDFEGLRRFHRNLDLGLLGRRIERSPLPFGRDRWVSSPPSVDIEVAEGARPRSELSEWADERGRLPVNAERGPAWHLGVAHFTDGSTAVSLVASHLVVDGLGFCLAIADAVNGTARDLGYPPPRSRHRLRAVVQDAYQSARGTHEVARALFTAVQAGSRRRSDVARVRAARPMPIHRSNPDDGVMAPAITIYIDPDEWDARAKSLGGTSNSLFAGVAAKLAEHSGCRSADDGTVAISFPVSDRTEDDMRANALSFVIVIVDPAQATTDLRGIRGAISQALQTLQENPEELLQVLPLAPLTPKRVMRKLAHVAYGYTDVGCSAIGELDPAVGRPDGTDADHVFIRGVRQRFTRQNFDRPRGIFMVSGRIRGRMFITIVAYQLEGRDSKHHLHELVAQTLSEFDLTGTID

SEQ ID NO: 5200 - protein, 74 aa, Mycobacterium paratuberculosis
MATRKRHTPEQIVRKLTAARLRAAGNETAAVCRELGVSEVTYHCWRNQFGGLKAEDAKRLKDSNARTPPSMGSG

SEQ ID NO: 5201 - protein, 149 aa, Mycobacterium paratuberculosis
VDFQFDVSIDGRPIKIVSIVDEHTRECLAGMVERSITGEHLIAELDQLAVQHGTYPGCCGATMPPELACSAIAGWASGQIGPGSHQRLETRLQPPPPTLGPGHWCGMARDPIILDQATPPGRQPSCNKRPRSSRMARWWVIWPSVMVKM

SEQ ID NO: 5202 - protein, 286 aa, Mycobacterium paratuberculosis
MISSVGVQIQPAGTPNYRTWRAAVIQAECMGADLIFGYDHFHEPVFDKATDAGPVLSPHQPEVNHFEGWSALASWGEIINRAQIGLLVTGVGYRNPDLLADMARTVDHISNGRLILGLGAGRYEKDYATYGYEFGTVASRMSLFDASLARIKYRLAQLKPPPLHPIPILIGSSGEKKTLPRVARHADIWHTFLPIEQFRIKSQLLDDLAQHNGRDGTAITRAVPWFDDKSADEYVAAGARVLIVQMRPTEQGYDFSQLIKLLTWPRQAVLRTKLTQPISRKAKADV

SEQ ID NO: 5203 - protein, 368 aa, Mycobacterium paratuberculosis
MAAMAVSATAGIYPFQYTLADDVQGVLSGLNSYDRDAWAAAFSAVAARYQARAEEAEQIGDTSVAHENYLRAYGYYRMARYPTMNSAGKKSAYRKSQEMLLRASRYFDIPIERVEIPFAGRPGEGDRIIAHLRVPKATDRLPVLLVSGGIDTFKEDMHTDQVLARNVATLAIDIPGVGDAPLAGSEDAERMFTPVLEWIAGRPELDPAGVGYWGGSTGGYWAAKIAHTHRNSLACVVSQGGCIDHGFDAEWIEQAQSGEYPFELAETLAYAFGRDTFEQWVDYAPKLSLVRQGILDRPCAETLLINGLHDTVFPISDYYLLLEHGSPKSARFFATGHMGYTADTQSIILDWITHRLQPSRDRQPGGGQ

SEQ ID NO: 5204 - protein, 252 aa, Mycobacterium paratuberculosis
VSVMVGYLECRPLGALAPYVDCGWVRSNTAGGALRVMPDGCVDLFVTAEGAVMVSGPATTFYDQCAGTEGAMIGLRLRPGAAAAVLGHPVSELRDTQIRVDSVFGTSASGLAEDVLEANAFRQRVALLAAVLARYVVKIDPVVDQPVAHSIEMLRVHPARSVSDVASSVGLSERQLRRRFDAAVGFGPKRLGRIFRFQRLLDLIHAGDHRIRWADLAIEAGYADQSHLISECLALAGAAPTELPGAARPRHA

SEQ ID NO: 5205 - protein, 411 aa, Mycobacterium paratuberculosis; identical to SEQ ID NO: 1459

SEQ ID NO: 5206 - protein, 128 aa, Mycobacterium paratuberculosis
MSLPLDAADERNRYCIQLYHRTAAQADLSGRRVLEVGCGNGGGASYLTRTMRPASYTGVDLNQAGIAFCRKRHIVPGLDFVRGDAQNLSFPDESFDAVLNIESSANYTSLSGNVPGRGVNSGGVSVLM

SEQ ID NO: 5207 - protein, 242 aa, Mycobacterium paratuberculosis
MDTVIAMALIAATNPVRLGIALLLISRSRPVLNLLAFWLGAMATAITAGVGVLTVVHSFAPTLMQSVSALSATPDARHTQIAIGLVILAITALVAVSSSVRPTRVTSASVDRRAGLPRPNTPSTLARLRGRIRDVLTSDGLSVAFILGLGSGFPAVEYPIALAAIAASGNSVGVQFSAAVMFTVVMLLVIEIPLVSYSASPAQTQAVMQRIHDWVLPRRWQLLAVVVAAEAVWMVAAGLGGA

SEQ ID NO: 5208 - protein, 408 aa, Mycobacterium paratuberculosis
MKFALAVYGSRGDVEPHAAIARELLRRGHEVCVAAPPDLRGFVESAGVTAIDYGPDTRDVLFGKKTNPIKLLSTSKEYFGRIWLEMGETLTSLANGADLLLTAVAQQGLAANVAEYCDIPLATLHCLPARVNGRLLPNVPSPLSRLAVSAFWCGYWCVTNKAEESQRRRLGLSKASGSSTRRIVGRKSLEIQAYEDFLFPGLAAEWAHWDGQRPFVGALTLGLPTDADAEVLSWIAAGSPPVYFGFGSLPVKSPADTVAMISAACTRLDERALICAGTNDLTHVPRSGHVKIVAAMNHAAIFPACRAVVHHGGAGTTAAGMRAGVPTLVLWMRNEQPLWGAAVKQMKVGSSQRFSKTTEESLATCLRSILRPHYMTRAREVAKRMTKSSDSAAVAADLLENAARGETT

SEQ ID NO: 5209 - protein, 506 aa, Mycobacterium paratuberculosis
VVLVGKVEVGPIHEWLPAAGSVVSWQASPASLDKARHAPNSAVPASYQQAQHLRRFRENAARGIDMSRLLTAGWDIPGRCDIRVMTHVINAHLRRHDTYHSWFEVEDGGRIARRTIDDPASIKFTPIEHGEMTSDEVRDLVLDTPNPLCWDSFRFIVIQRADHFTICLCVDHLHIDAMFVGVGFAEIHLMYRALVAGRAPLTLATAGSYDDYCVRQHRELDALTLESPEVRGWVEFFEDNNGTLPAFPLPLGDGPVPCDMLSVQLLDERQTARFESVCLAAGARFSGGVFACAALVEHELTGTETYYGVIPVDIRRSQDELATTGWFVGFVPLTVSVAGSFSDIVRTAQASFDSNKDLANVPAERVVEMAPWLRMPQRGAPLLFFLDAGVPPLSALVNSHLDGANARLYHDGRIPSQVAIRVNRLESETQVIVLFPNNPIARQSVTRYLAVMKSVYARVVDGGDPVESHLNHAAMHPQLGSRREARNEWAGSNWSHPMQRVAQPFG

SEQ ID NO: 5210 - protein, 2098 aa, Mycobacterium paratuberculosis
VTHPLRRGTTMDESATPVAVIGMACRLPGAIDSPDALWAALLRGDDFVTEIPLDRWDADEHYDPEPGLPGRSVCRWGAFLDDVGGFDADFFGISEREATAIDPQHRLLLETSWEALEHAGINPAALTGSRTGVFVGLMHDDHTLRTADAGALDQPYGFMGNSFAVASGRIAHTLGLHGPALTVDTACSSGLVSVHVACRSLHHGESDLALAGGATVLLEPRKLAAGSAQGMLSATGRCRAFDAAADGFVSSEGCAMVLLKRLPDALRDGDRILAVVRGTAANQDGRTLSLATPSLTAQTAVYRSALAAAGVDAGTVAMVEAHGTGTPVGDPIEYASLAELYGQDGPCALTSVKTNFGHTQSAAGTLGLVKAVLALQHGVVPQNLHFTRLPDKIGQLNTNLFVPQDNTPWPRKLQQPRRAAVSSYGVSGTNAHAIVEQAPNASGGVKPTPAGPLLFTVSSSSDEGLRETAKRLAGWVKERAASVELSDLAYTLARRRAHRPVRTAVIAGSVDELAAGLHEVADSRTSYLAAFGRDDCGPVWVFSGQGSQWTQMGAELLANEPVFATTVAEVEPLIARESGFSVTEAMSAPHTLTGIDKVQPTIFAMQVALAATMKSYGVRPGAVIGHSLGETAAAVVAGALSLQDGVRVICRRSRLMSRIAGAGAMASVELPAQQVLSELMARGIDDVVVSVMASPTSTVIGGVTSTVRELVAAWEERDVLAREIAVDVASHSPQVDPILDELADALVELEPTAPEVPFYSASLFDPREQPLCDADYWLDNLRHTVRFGAAVQAALEDGHRVFVELSPHPLLTYAIEQTAASLDTPAAALAAMRREQALPHGMRDLLAEVHSVGAAVDFSMLYPDGRLLDVPLPAWTHRHLLLGLDSRDTQPQAGPTVAVHPLLGSHVRLPEEPERHAWQAEVGTATLRWLADHRIHEVAALPAAAYCEIALTAAHTALGDASEVRDLRFDQMLLIEDETPVFALAVMASRSAAEFVVETFEEGERVRRATAILAAAGPGERPPAYDVPALLAARSSSVDGAELRNRFAERGVQYGPAFTGLTAAHTSGDTVLAEVALPGAMRSQQRAYRIHPALLDACFQSVGAASEIQNSGGGSLLLPLGVRRIRAYASARTAHYCYTRVTSTTATGFEADLDVLNEHGAVLLSIQGLQMGTGASEEASRDRALNERLLTVEWHRQELTEVDPVDAGTWLLVSTSAMADVAATELTDSLKLLGADCTSIRWSSRADPVANGKTLRDQLRVGRFTGVVLLTGPKDGDRDDECAARGGEYVRHVAHIVRELAAAPGEPPRLYVVTRNAQTVLEGDGANLEQGGLRGLLRVIGNEYPQFRTTQIDTDMHTGASLIARQLVSGSEEDETAWRNDEWLTARLRLSPLRPDERRTAVVDHEHDGMRLHIRAPGDLQTMELVACERIPPGPGQIEVAVTASSINFADVLLAFGRHPSFEGRLPQLGTDFAGMVTAVGPDVIEHKIGDHVGGLCPNGCWGTFVTCDANVAVTLPPGLTDAQAAAVTTAHATAWYGLHDLARVKAGDKVLIHSATGGVGQAAIAIARAAGAEIFATAGSSQRRKMLHDKAIEHVYDSRSVEFAEQIRRDTDGYGVDVVLNSLTGAAQLAGLKLLAPGGRFIEIGKRDIYGDTKLGLFPFRRNLAFYGVDLGLMSVDHPLRVRELLDTAYERVADGLLPMPASTHYPLTDAATAIRVMSAAEHTGKLVLDVARSGKSSAVLHPDSGRVFRPDGSYIITGGLGGIGLFLAEKLAAAGCGRIVLSSRSEPNQRVQEMIELVRAIGSDVVVECADITQPGTAERLVAAATTTGLPVRGVLHAAGVVEDSALGGITGELLERCWAPKVVGAWNLHRVTAGEPLDWFCLFSSAAALVGSPGQGAYAAANSWLDAFTHWRRAQGLPATAIAWGAWSELGRATGFAEDVGTAITPDEGAYAFQALLCHDRAYTGYAPVIDTAWLSAFAERSRFAEAFRSTGKSPTGTTRFLAELNTLPHDQWPTRLRRLVSEQVSLILRRTVDPDRPLSEYGLDSLGNLELRTRIEAEAGVRIKSTAITTVRGLAAHLCDTLAEAAPTSQVRAE

SEQ ID NO: 5211 - protein, 538 aa, Mycobacterium paratuberculosis
MTAPIWMASPPEVHSALLSSGPGPGSLLAAAGAWNSLSAEYASTAEELSAVLASAQAGAWGGPSAESYVAAHAPYLAWLTQASANSAEMAASHEVMATAYTAALAAMPTLPELATNHVVHGVLLSTNFFGINTIPIAVNEADYARMWTQAAATMSTYQAVSTAAVAATPPTDPAPPIVKSAALSDDSDDSGDVDHDPKIDNWLDELIARFLKQLGINWDPAQGTVNGLDYDAYTNASQPIFWVVRALELLEDFQQFGYYLVHNPALAFQYLVQLALFDWPTHILEILTTAPQLLAPALLLAVAPFGAIGGFAGLAGLAAIPHPAVVPATVAAPPPAPTPSIPPAIAMAPTPVAPAAAPASAPAPAPATTATTVAPAPAAPAPVAAGAGFFPPYVVGPPGIGTGSGMAASASSSAKRKAPEPDSAAAAAAASAREAARARRRQRQRQRGFGDEYMDMNVDVDPDWGGPHPGRESVASDQGARNVGFAGTARRNAAAAAGGLTTLADDEFGGAPKIPMMPGTWDPVGDGERREQGDGRDH

SEQ ID NO: 5212 - protein, 330 aa, Mycobacterium paratuberculosis
VPVATLKPGRRPGSMELLVGILLACALAATTLRNAVINSAALSTVGTVFCGVFVQAIPFLVLGVVVSGLIAVFVSPERLARWLPRRASMAVLAAGIGGAALPGCECGSVPLARRLFGEGAATGAAALTFMLAAPAINPVVLVATAVAFPGAPRMVFARMIASLLTAVVMGWVWSRWGRAEWITRRLPAAGTATESRWTTFTEAARHDFLQAASYLVLGAIAAALLHVMVPQWAFAHLADNPVLAVALMAALAVVLALCSEADAFVAASMTMVPLLPRLVFLVVGPAVDVKLFAMQAGMFGRAFAARFAPCTFAVATASAGAIGLFVLGPG

SEQ ID NO: 5213 - protein, 88 aa, Mycobacterium paratuberculosis
MPKKPARTRRPAPLAGRARKKNLLDSLGLRTVDYKDTATLRVFISERGKIRSRQVTGLSVQQQRQVATAIKNAREMALLPYPGQGIKP

SEQ ID NO: 5214 - protein, 101 aa, Mycobacterium paratuberculosis
MAKKSKIVKNDRRRATVARYAERRAELKEIIRSPRSTPEQRTAAQNELAHQPRDASAVRVRNRDAVDGRPRGHLRKFGLSRVRVRELAHAGQLPGVRKASW

SEQ ID NO: 5215 - protein, 54 aa, Mycobacterium paratuberculosis
MARNEIRPLVKLRSTAGTGYTYITRKNRRNDPDRLVLRKYDPVIRRHVEFREER

SEQ ID NO: 5216 - protein, 398 aa, Mycobacterium paratuberculosis
MRTPVILVAGQKDTDPVVGALLRMPGTLVVEHRMEGHVVLRTTVMLQHGVLTTAESALELAHGCVSCTIRNDLLVLLRQLHRRAEVERIVVHLAPWLEPEPICVAISHVRVRVAAGYVDGPAALDVSIAAVVTCVDSSVWVSQALGDEELDDGRTQAQVVVGQAEFADVLVLNRADPFTAAALRRLAPRARIQVGANGIGDTLNNLYRDARQGRSDDPHDPLLSGQPPLNSRGPINLVEFHARRPFHPRRLHECLDVVLDGVIRTRGRLWLASRPSHAMWLESAGAGLRVSSAGKWLAALAPSELAHIDPGRRAFAELEWDADHGDRHTAMTILVCGANASDILDALNGALLTDREFASRPWVFDDDPFGDWHEDPCGDPAQGTEENTPAHYSTDGDH

SEQ ID NO: 5217 - protein, 97 aa, Mycobacterium paratuberculosis
MKSGIHPDYHPVVFQDATTGATFLTRSTITSSRTIEWETPHGVRTYPLVVVEITSDSHPFWTGSRRIVDTAGQVEKFHRRYGSRRQTNHRDDAAHSP

SEQ ID NO: 5218 - protein, 380 aa, Mycobacterium paratuberculosis
MPPQSSTPLPVTVLSGFLGAGKTTLLNHVLANQEGRRVAVIVNDMSEVNIDAALVAGTGFLDRTEEKLVELTNGCICCTLREDLIESVARLASAGRFDYLLIESTGISEPMPVAASFSWEFENGFSLSRIARLDTMVTVVDASTFLRELARGEALAARHLAAGDGDVRTIADLLVDQVEFADVILLNKTDLVSEKTNATVAAVLRRLNPAAKIVPTDHGRVALSEVLDTGLFDPHLAAESAGWAEELANGHSPETEEYGISSVTFRAARPLHPQRLHVALGQLQGVLRSKGFCWIASRPDIAAIWSQAGPNLVIEPAQYWSTADFPAGQEIVFIGVNLDHSRVLDLMQAALLTDTELAQGPQRWVGYPDPLPPWDVVHAH

SEQ ID NO: 5219 - protein, 139 aa, Mycobacterium paratuberculosis
VSSPAAPRRRRATVKQRTVLEVLRAQENFRSAQQLYQDIRQNQQLRIGLTSVYRILRALAADRIAETQRAEDGEILYRLRTEAGHRHYLLCRQCGRAVAFTPVDIEEHTRRLSRQHHYADVTHYVDLYGTCPLCQNTQP

SEQ ID NO: 5220 - protein, 307 aa, Mycobacterium paratuberculosis
VTVRVLALQYEPHWWSILTSGFMTNALIGGTIVALAAGLVGYFVVIRQSAFAAHALAHIGLPGATGAVLLGVPVAAGLGVFCVGGALAIGVLGKRAADREVVTGTVLALAIGLGLFFNSLATKSSGTMTNVLFGNLLAISRDQLAGFAILLAVLALIVGIIYRPLLFASVNPVVAEAKGVPVRALAMIFMALLGLTVTMAVQAVGTLLLFALVVTPAATAIMLTPRPSMAMLVSTAIGLSSVLLGLGASAMFNLPPSFPIVVLACGIWSAVWASNHRHRVIAKAVDEATNAPPALMSSTEPTATTRK

SEQ ID NO: 5221 - protein, 242 aa, Mycobacterium paratuberculosis
VRGGRLIWSHATFDIPAGGIVAVIGSNGAGKTTLLNMVLGLIPSATGRLEIFGRRPGQANDNIGYIPQHYADSSGEAIRAADAVLLGLTGRRWAFGRSTTSQQTRVAEALAAVEATDLGCRRLSTLSGGQRQRIAIAVALVARPQLLILDEPLASLDLRSQRDIVALLARLHAELAVTILVVAHDLNPLLPILDSVIYMLDGRPRYVPVGDIMDDTLLTRLYGTPIHVHRARDGALYMRSAL

SEQ ID NO: 5222 - protein, 369 aa, Mycobacterium paratuberculosis
MATVGACCRSGGPAGVPRNRAGAHRDADRVSGKSRALDMKTVIVCGVGGLLSRWHGAPIATVLVLTVVTSCSSSPTQTAEGSRNAASPSAIGRTAAPPCPTAPLAVVVSVDQWGDIVSELGGACANVKTVLASSSVDPHDYEPSPADAADFMNAKLIVVNGAGYDSWASKLAGSSASGAPLVSAAAVTTTPDGANPHLWYLPSAVTAVADAVTQELSRMEPPAAGYFSQRRAQFTSATRLYVNLIAKIKAEAAGKSYGATETVFDYQAQAAGLVNKTPAGYRRASANESEPSPGDVDAFLTALAGRHIDLLIYNTQTEGSIPEEIRSAAEQSSVPVVKITETVPPGETSFEDWQYGQLVQLAKALHVAV

SEQ ID NO: 5223 - protein, 182 aa, Mycobacterium paratuberculosis
VRSEGDTWDITTSVGSTALFVATARALEAQKPDPLAVDPYAEIFCRAVGGTAADVLDGKDPDHQLKTTDFGENFVNFQGARTRYFDNYFARTATRACVRWSCWRRGWTRAPTAWTGRPRPRSSSSTSRRCSTSSVRCSPGPAPSRAPSDARSPSICARTGRKPSATAASTRPNPRRGSPRAY

SEQ ID NO: 5224 - protein, 242 aa, Mycobacterium paratuberculosis
GSRPSAEDHRLRRKLRQLPGRPYQVLRQLLRPHGDAGVRQVVVLAAGLDSRAYRLDWPAATTIFELDQPQVLDFKREVLARAGAQPRAERREIAIDLREDWPQALRDSGFDPAKPSAWIAEGLLIYLPASAQEQLFTGIDGLAGHGSHVAVEDGAPMKPEDFETAVAEERAATAQGDQRVFFQLVYNEQCAPATEWFGNRGWTAVGTPLADYLREVGRPVPGPETEAGPMIARNTLVSAVRA

SEQ ID NO: 5225 - protein, 617 aa, Mycobacterium paratuberculosis
VEHGDTGMLTVQPANSRVDTRVDGDVVSRFATCCRALGIVVYQRQRPADLAAARSGFAALTRIAHDQCDAWTGLAAAGDTSLRVLEAVSRTAASAGVLQRQVDLAPNSLGFRYDTGLYLQFRATTPDDFHLAYAAALATAGRFADADAIVAGLTAERPNWREARWVSVVINYRAERWSDVVKLLTPIVNDTDLDEAFSHAAKIALGTALARLGMFAPALSYLEEPEGPVAVAAVDGALAKALVLRAHVDEDSASEVLQDLYAAHPENEQVEQALTDTSFGIVTTTAARIEARTDPWDPETEPSAEDFVDPAAHERKAVLLHEAERQLAEFIGLEEVKNQVSRLKSSVAMELVRKQRGLAVAQRAHHLVFAGPPGTGKTTIARVVAKIYCGLGLLKRENIREVHRADLIGQHIGETEAKTNAIIDSALDGVLFLDEAYALVATGAKNDFGLVAIDTLLARMENDRDRLVVIIAGYRADLDKFLDTNEGLRSRFTRNIDFPSYAPSELVEIANKMAEQRDSIFEKAALDHMEELFTKLATESTPDANGISRRNLDIAGNGRFVRNIVERSEEEREFRLDHSEHAGTGEFSDEELMTITDDDVARSVEPLLRGLGLSVPA

SEQ ID NO: 5226 - protein, 539 aa, Mycobacterium paratuberculosis
MTSNQQPDERRSFSSRTPVNDNPDQVEYRRGFVTRHQVSGWRFVMRRIASGIALHDTRMLVDPLRTQSRAVAMGAVLLVTGLAGCFVFSLIRPNGTAGTNAVLADRSTAALYVRVGEDLHPVLNLTSARLITGRPVDPTMVKSSELDRFPRGNLIGIPGAPERMVQNPSTDANWTVCDAVSEPGGHAAHSAGVTVIAGRPDSSGARAATLPSRQALLADRDGTTWLLWDGKRSQINLTDHAITNALGLGQGNSEIPAPRPIALGLFNAIPEAPPLTAPGIPNAGAPAPFTAPAPIGGVVVSYTLDQSSSGAPRYYAVLPDGLQQISPVLAAILRNTNSYGLDQPPRLGADAVAKLPVSRMLDTARYPDQQVGVVDAAKSPVMCAYWSKPAKAASSSVNLLTGSALPVAESIRTVDLVGGGSPATAARVALAPGTGYFTQTVGGGPNSPGAGSLFWVSDTGVRYGIDNEAEHSAAGQNKTVEALGLTGSPVPIPWSVLSLFASGPTLSRADALLAHDGLAPDQKPGRVTAAAREAEGAPR

SEQ ID NO: 5227 - protein, 1329 aa, Mycobacterium paratuberculosis
MSRLIFEARRRLAPPVTRKGTIAIEAPPELPRVIPPSFLRRAMPYVLVILIVGMIVALFATGMRLISPQTLFFPFVLLLAATAMYRGNDNKTRTEEVDAERADYLRYLSVVRDNIRTQAAAQRAAAQWSHPEPAALAAVPGSRRQWERDPHDPDFLVLRAGRHHVPLATALRVNDTADEIDLEPVSHSALRSLLDTHRTVRDVPTGIDLAKVSRITVLGSEDEARSAMRAWVAQAVTWHDPTVLGVALVTPDLENPDWSWLKWLPHIDIPGELDGVGPARFMATNVDELVAKLGSALVDRPAFTGEPADALRHLLIIVDDPDYDLSASTLAMGRAGVTVVHRGATAPHREQYSDPEKPILRITGADGAGGRTHSIERWQTGGWQPYIDDADQLGADEAAHLARQLSRWDSNPTHTGLRSAATRGATFTTMLGIPDASQLDVPTLWAPRRREDELRVPIGVTATGEPLMFDLKDEAEGGMGPHGLMIGMTGSGKSQTLMSILLSLLTTHSADRLIVIYADFKGEAGADSFRHFPQVVAVISNMAEKKSLADRFADTLRGEVARRETLLREAGRRVQGSAFNSVVEYENAIAAGHDLAPIPTLFVVADEFTLMLADHPEYAELFDYVARKGRSFRIHILFASQTLDVGKIKDIDKNTSYRIGLKVASPSVSRQIIGVEDAYHIESGKEHKGVGFLVPAPGATPIKFRSTYVDGIYDPPQKAKSLVVPSIPEPKVFTAGRVEPDQDTVITSPDEVELTGPPRKLIATIGEQLARYGPRAPQLWLPPLDEPIPLSAMLARAGVPPRQWQWPLGEIDKPFDMRRDPLIFDAASAAGNMVIHGGPKSGKSTALQTFILSAASLHSPREVTFYCLDYGGGKLRALEDLAHVGSVASALEPERIRRTFGELEQLLLSRQRRQAFRDSRGGVPDDGFGEVFLVIDNLYAFGRDNTDQFNTRNPLLAKVSELVNIGLAYGIHVVITTPSWLEVPLAMRDGLGLRLELKLHDPRDSNVRVVGALRRPAEAVPHDQPGRGLTMAAEHFLFAAPELDQIAAINDRYPGMAAPPVRLLPTNLAPHAVGALYRGPEQVVIGQREEDLAPVVLNFADNPLLMVFGDSKTGKTTLLRHLIRTVREHSSPDQVAFTVLDRRLHLVDEPLFADNEYTANIDRIIPAMLGLANLIESRRPPAGLSPQELSRWTYAGHTHYLIIDDVDQIPDSPAMSGPYVGQRPWTPLIGLLSQAADLGLRVIVTARATGSGHALMTNPLLRRSNDLQATTLMLAGNPQDSGKIRGQRFGRLPAGRAILLGDSDAPTYVQLVNPLAGESVMASEAQREE

SEQ ID NO: 5228 - protein, 102 aa, Mycobacterium paratuberculosis
MTLRVVPEGLAATSAAVEALTARLAAAHAAAAPAITAVVPPAADPVSLQTALGFSAQGQEHSAVAAQGVEELGRAGVGVGQAGASYLAGDTAAAATFGIAGA

SEQ ID NO: 5229 - protein, 493 aa, Mycobacterium paratuberculosis
MTSPFGPIWMASPPEVHSALLSAGPGSGPLLAAAGAWASLSAQYATAAAELSALLGQVQAGSWEGESAEQYAAAHLPYLAWLQQASADSAGAAAQQEVAATAYTTALAAMPTLAELAANHTIHGVLLATNFFGINTIPIAVNEADYARMWVQAATTMGTYQAVAGSALAAAPRTAPAPSIVKPGGEANNLAANAAQNSSGDWWQNFIQQLSQFFQNIQKMLQDFWANLPAFLAANGPLLFFVAYQVFFNAVGWPTWGAILTAPFLLPLLLGIGLSSLLAAPAEIAPVAAPAAITPVLASNKPPTLPAAVALAPSVATPAGAPASTVAAGSGASAAPAPAAAAGNFAYLVAFGGDPDTGVGPTLSGRGGAKAPAATIPAAGAAAPARAEARARRRRRAALHDYSDEFLDMDSGFGVPPDYGAEEELAAAVASGQGAGTLGFAGTQQRRKAFQAAGLTKLADDDFGGSPRMPMVPGTWEQDTQNGAHPTEPGKGG

SEQ ID NO: 5230 - protein, 97 aa, Mycobacterium paratuberculosis
MSMLDAHIPQLVAAQSAFSAKAALMRSTISQAEQEAVSAQAFHQGESSAAFQAAHARFVEVAARVNTLLDIAQANLGDAAGTYVAADAAAASGYTAF

SEQ ID NO: 5231 - protein, 96 aa, Mycobacterium paratuberculosis
MSQIMYNYPAMLSHAADMSGYAGTMQGLGADIASEQATLSNAWQGDTGMTYQVWQAQWNEAMESLVRAYQSMASTHEANTMSMLARDQAEAAKWGG

SEQ ID NO: 5232 - protein, 293 aa, Mycobacterium paratuberculosis
MDPAPNAVELTVDHAWFIAETTGAGSFPWVLAITCPYRDAAERNAFLDRQRAELSEMGLVSDAGLINPAVAEWIKVVCFPQRWLDLRYVGPAKDTGEGGGSELLRGIVAQRDGAGGRSITVVALRSAQLITFTAMDIDDPRALVPVLTVGLAQRAPASFDEFSMPTRVGARADERLRAGAPLSEVLDYLGIPQSARPVVESVFNGPRSYVEIVAGCHRDGRHSTTEVGMSIVDAREGRVLVSPSRAFDGEWVSTFSPGTPFAIAVAIEHLTALLPDDGWFAGHRLARDFSVQH

SEQ ID NO: 5233 - protein, 480 aa, Mycobacterium paratuberculosis
VTSGTVMPIVRVAILADSRLTEMALPAELPLREILPAVQRLVVPAAANGDSEDGAPSRGAAEVGGAVQLSLAPIGGAPFSLDASLDTVGVVDGDLLALQPVPAGPAAPGIVEDIADAAMIFSTSRLRPWGTTHIQRFALAAVIAVALLATGLSVSYRVATGALAGLVAVSAVAALTAIVGLLATARSPRTGMALSIAALVPIGAALALAVPGRFGPAQVMLAAAGVTAWSLIALMAPSAERERLAGFFTATAVLGAAVLLAAGAELLWHITPVALGCGLIVAALLVTVEAAPLSALWARFPLPVIPAPGDPTPSAPPLPVLEDLPRRVRIGDAHQSGFIAAAVLLSVLGSVAIALRPETLSAAGWYVVGATAATSVLRARVWDSAACKAWLLAQPYLAAGVLLVLYTATGRYAGALGAVLVLLALVAVWIVVALNPGIAAPESYSLPVRRLVGFVATGLDASLIPVMAFVVGLFGWVLDR

SEQ ID NO: 5234 - protein, 468 aa, Mycobacterium paratuberculosis
MIRPASACLAAALALLPATATWASPPALAISPPTVDPGVPPPSGAPGPGQPMEQRAPCTTSGVIPGSEPAAVTPSQSALNLPAAWRFSRGDGQLVAVLDTGVRPGPRLPNVEPGGDFVETTDGLTDCDGHGTLLAGLVAGQPSPDDGFAGVAPAARVVSIRTTSAKFSPRTPGGDPLLARAAAEVGTLARAIVHAADLGARVIDIGSATCLPVDRPVDQAALGAAVRYAAVDKDAVIVAAACDSGPTGSFAGGTSCESNPLTDLSRPSDPRNWAGVTSLSIPSWWQPYVLSVASLTPDGQPSKFTVAGPWVGVAAPGERIVSIGNGDGAGLTNGLPDEHQQLAALNGTGYAAGYVAGVAALVRSKYPDLSATAVVHRITATAHNGARDPSNVVGAGSVDPVAALTWQLPAGDQPGPAAKPIAVPPAPAPPDTTPRTVAVAGTAALVVLVAVAGAVIALAARRRKDPSA

SEQ ID NO: 5235 - protein, 240 aa, Mycobacterium paratuberculosis
VRPPNGSDALPLPLIAGYLDRYGIRADKVRITSRDNASDESRRQTWIGLTVSAPDNLAALQARSPRIPLAETAQVAARRLADHLRETGWEAGVVPPDDVPRLLTSNPRERWRGVQRGPSDYLAAYQIPVDESLPETLEAIRSYPARQSCVALEIAGDKAAPTIAVACAFQTDTAPDRGAPLAGLIPQRGNHLPALTALDLLSTGRLDGHTAATADLLDRLHWPTQGAPAGDADTVAAART

SEQ ID NO: 5236 - protein, 399 aa, Mycobacterium paratuberculosis
VAPDLDPFDPPIPVPDVPGADVPPGAGGLPPTSALSPRQRMVVEASALGDLALRTWVASLLSTTVAPFVVANALRHADAATERANLEFYAELGAAADPDRSFPPPTEPPRVTSRRASPLAEWVARGTVDNLAFDSSFTAVNPAMRARWSGWGRNNVVRAQHWRHDDGPRPTLCVIHGFLGSSYLANGRFFSLPWYYRAGYDVLMYTLPFHGKRSERFSPFSGFGYFAGGLSGFAEAMAQAVHDFRSLIDYLRHTGVERIALTGISLGGYTSALVASVDDRLEAVIPNCPVVTPATLFDEWFPANKLVGLGLRSSDISRAQLAAGLAYHCPLTYRPVLAKDRRMIITGLGDRMAPPERAVKLWQHWDRCALHWFPGSHVLHISQLDYLRRMTAFLQQVMF

SEQ ID NO: 5237 - protein, 269 aa, Mycobacterium paratuberculosis
RRRVDQEDRHVGSGRLPGLCRPSGPSLLRSAVAGGRRAGAPRRRSRVRARPPDQVPGPALAGRGHRGDGQLPGDGRRGQGARHRRRHRRSAQLETQTRHRRGGQQRRPALGARTLRPAAALGRAAGARVVDRGADAGQLRVPVLRRGARPGPPGAVREVVARIPFRVGAVVQPPTHYANMLLDAGCKVDVWETTYLHQLTGEHPVLEWITGTALVPVRERLDDDAWEQFREELIPLLRDAYPPRADGTTIFPFRRVFIVAEVGSGRPAA

SEQ ID NO: 5238 - protein, 477 aa, Mycobacterium paratuberculosis
EVTQLTPGDAGDRNDAGRKDNVLIVHWHDLGRYLGAYGHRDVSSPRLDRLAAEGILFTRAHATAPLCSPSRGSLFTGRYPQTNGLIGLAHHGWEYRSGIRTLPQILSEAGWYSALFGMQHETSYPKRLGFDEFDVSNSYCDYVAQRADEWLRQSAEGVVGQPFLLTAGFFETHRPYPEDRYPPADSAEVQPPDYLPDTPEVRGDLAAFYGAISTADAAVGRLLDTLADTGLDASTWVVFFTDHGPAFPRAKSTLYDAGTGIGMIVRPPTGRGLPPRVYDELFSAVDLVPTLLGLLGISVPPDVDGVSHASALLRPDPDAAPVREHVYTMKTYHDSFDPIRAIRTKDYSYIENYASRPLLELPWDIEESPSGMAVAPLVTAPRPERELYDLRADPTEITNLLAGDDADADEVAANLAVLLHDWRQRTGDVIPSEFAGTRIAARYTETYLQIHHGARPTARSAIAADRGIEEEGNPAQR

SEQ ID NO: 5239 - protein, 219 aa, Mycobacterium paratuberculosis
VTGPAFSPQERRAVYRVISERRDMRRFVAGAVVDEQVLARLLAAAHAAPSVGLMQPWRFIRITDAALRRRIHALVEQERPRTAAALGERAQEFLALKVEGILECAELLVVALGDDRDKHVFGRRTLPQMDLASVSCAIQNLWLAARAEGLGMGWVSLFEPRPLAELLGLPDGAEPVAILCLGPVPEFPDRPALELDGWATPRPLAEFVCENRWAQPQLP

SEQ ID NO: 5240 - protein, 94 aa, Mycobacterium paratuberculosis
VKPSDVLEQLAADRGADRGYGEPYQTPDGTTVIVVGKPQGVFTIRDGQARWTPAVDTGRVALIGVITGLLAAVIGSLAVLRQPPWPRITIRDYR

SEQ ID NO: 5241 - protein, 160 aa, Mycobacterium paratuberculosis
MAVFVRRLFGIGKLPDDLHAQVEAEGLIYLADYVAVTRRFSGTIPGVRLPHSVASYTGSLVFTSERVLATLSMLPRLAGPTVNVAWDAPQTGAAQVEISSTGLQVDVDVSRVDEKFSGELSLHYKVAIPADVLSGLPRHSLAFDMPPEYVFRAVGVTYSP

SEQ ID NO: 5242 - protein, 234 aa, Mycobacterium paratuberculosis
MLPSMTARAPSRGRAGIDGAMMRPRPAPAAAIALLATAVYAVMWIGYRHGWGWLARMDWSLLNGTRDLAVKHPDWLRAAEVVSVVLGPGTLAVLGIAVTLCAVVLRRLRAALVLALACAPCNELVTAGAKALVDRPRPPTALVGAASTSFPSGHALEATAGLLAMTLFALPMLNRVLCGLLVAAVAVALPAVGLSRVMLNVHYPSDVLAGWSLGYLYFLLCLLVFRPSAPDRSG

SEQ ID NO: 5243 - protein, 219 aa, Mycobacterium paratuberculosis
MHRLLTSLCAAACVIVASVVLSPISAAAGAPWFANAVGNATQVVSVVSTGGSNATMEIFQRTGTGWQSLRSGVPTHVGSAGMAPQAKSGVPATPMGVYSLDSAFGTAPNPGTGLPYTQIVGPNYWWSGDDHSPTFNSMQVCPKAQCPFNTAESENLQIPQYKHAVVMGVNKNKTPGGGAAFFFHTTDGKPTEGCVAVDDAQLVSIMKWLRPGAVIAITK

SEQ ID NO: 5244 - protein, 165 aa, Mycobacterium paratuberculosis
VCCNDPMTLDDLADIEAIKQVKYRYLRALDTKHWDDFADTLAEDITADYGPSIGNELHFTNRAELVEYMRTSLPANVITEHRVTHPDIVVDGDTATGSWYLQDRVMVAELNFMLIGAAFYRDTYRRTERGWKISGTGYDRTYDATMSLEGLNFTLKPGRAIAGAD

SEQ ID NO: 5245 - protein, 206 aa, Mycobacterium paratuberculosis
MSIAAGQQPGRPAGPTRRTTAPRKRGDDTRARIIDETVRCIIEEGFAAATAKHVAERAGVTWGVIQYHFGDRNGLLMAAVDDGVARLVESLSSADVSELPLRQRVEVVIDTAWSCYSSPTSMAAFEILHATRGALGDSSRRHLLDMNAAIGQLGRLITTDPANAGVAEVIWATLRGVVLAQMVIGTTVDWSLERRALIDMVTRVLQ

SEQ ID NO: 5246 - protein, 408 aa, Mycobacterium paratuberculosis
VAQSPYARLSRSELAVLVPELLLIGQMMDRSGMAWCISSFGRDEMVQIAIEEWAGASPIYTRRMQRALGYEGDDVITIFKGLQLDIGAPPQFMDFRYTVHDRWHGEFQLDHCGALLDVEPMGPDYVFGMCHTIEDPTFDATAVATNPRAQVRPIHRPPREPADRHPHCAWTVIIDESYPEAQPIPALHIVRQTRAAGWELDPIDASDEGMADYSGPLLSDLDFGAFSHSALVRIADEVCLQMHLLYLSFAIAVRKRAADDAEAVSVCTRGLTGVAGLAAERIHRAVGSGGGIDAVLRVLELHPLLNPAGYVVSEIAGNRLLVHRSPAHEDAAWISLCSPGSVQPLQAIATAVNPRIGVRVSGTDTDWTAEFVETDTDADELPEVSVTKVSGGSTFQFEPRRSLPLTVV

SEQ ID NO: 5247 - protein, 653 aa, Mycobacterium paratuberculosis
MYDPLGLSIGTTNLVAARNGSPPVSRRCVLTLYPHCAPKIGAPEENPLLAEPGVPMKGFVERIGDSVALVSPDGSAHDPELLTVEALDAMVLAAGADAASSEISIAVPAHWKPGTVQALRDALRTHLGFVRSGMAPRLVSDAIAALTAVKSELGLPDEGVVGLLDFGGSGTSATLVNVAGDFELVSATMRYTALSGDEIDQELQLRAFEELGHGSGLDPASTAGVGQLAALREQCRAAKERLSTDVVTEITAELGGRSCSLTLTQDDLEELMQDRLTGFIYAFDDLLVRYRKSWSDLAAVVTVGGGARIPLVTERLSMHGRTPILTPSQPAFAAAAGALLLASRGGELDMRTRTSIGLLAAADAAGDVVDLGAGDVLVIDDEALTDRELAWSQTEYPGDLRMRFGGETYDEDGPAGWSMRLNVIDPPKPRRPWRRLRFSQLIIGMSAAVAMTAIGGVAYTLTGIENRQAPPAPSVAPLPPVSRVVPPSAVAPPTAVPPPPPPSAQPVPSPAPPPPQPPPPPPSPPPAPPPPVVVTTAPPAPTYTPRHTAPPTAPPALTTTAPTPSPTPTTTPPPPTTTQEPTTTSTTTTVPMTTEWIHVPLLPVPIPVPVPQKQAPATPQYPSNEYPQYPQYPGNEYPQYPGNSQNPYYGPGY

SEQ ID NO: 5248 - protein, 645 aa, Mycobacterium paratuberculosis
RGVTKFMRDLPAMPSPGPVRVARGSARPWRRYVDIVLGVSMAPGTVRLVAIEGQNADGVTVEQEEFAVGAAENSANSAADQVIDAIIGTREGVFEGGHRLTSTGVTWTDPTGAAALRDAIASHELGNVMLVSPLLAAAALAQTVGYALGYGHIGMLFVEPRSATLAVVDVSDGSIVDLHRHQIPHGPGAPVAAELAAMVAGLDARDTRADGVFVVGCGTDIVAVKPALEAASPVPVTGPEEPDMALARGAALASANAPLFASSTAALAYALDPGTGEMDPPAFNPTYLDVWGDTGAGTGVRAYSAVPDEEEPAPRRPWSMLLAGGALAGIAAVIGGVVLVTLTSDGHGSNTRHNQGVSVATPGIQLPAPPPSNPPAAQPPAPSTPAPAPTPTEVAAPAPEPVQQAAPQTPVTPAPPAPVYRAPARAHTAVPAAARRAAGAAAGRRARPGRPTSGARAAAGRPAGAPPATGDDVPALPVRHGADPDHPAGAAARPIAPGTPGRPGAHWQVRHERQGGRVGEQGGFGFYPDEFDRMIREGSEGLREVFERVSKFVAAPGARTGWSSLFEDLSRRGRPAPETAGEAGDGVWAIYTVDAGGGAHVEQVFATELDALRANKDNVDPKRKVRFLPYGIAVSVLDDDPEQPG

SEQ ID NO: 5249 - protein, 220 aa, Mycobacterium paratuberculosis
MAANDDPEERIRELERPLADSARASEQGSAPPTGPGYPPAPAPWSYGGPVPGPPGQRPSGNRVWWVVGTLIAVGVLALTGGIAAFAAHQLSGVKSIINSPPTISRTFGPPPGISTTPAPSTSRRTPTSPAAPPGTELSVAGINENRTLACDDNPVSVSGVSNTVVITGHCTSLSVSGVQNTVTVEAVERIDASGFNNKVTYHSGTPSISNSGGSNVVGRG

SEQ ID NO: 5250 - protein, 171 aa, Mycobacterium paratuberculosis
VPDLPNRQILLRRRPSGLVRPDDTELVTTPAPEPAEGEALLRTTYVGIDAAARTWLDDQPSYLPPVQLGEVIRAAGIGEVVASRCDAFAVGDVVTTLTGFQEYAIIRDDLFSTPIPGEHDQLAIMSVYGPTGATAYFGMTDIGRPQPGETVVVSAAAGATGSIAGQIAKIA

SEQ ID NO: 5251 - protein, 151 aa, Mycobacterium paratuberculosis
VADFGFDACIDYKNDDVAAALKQHCPRRVDVYFDNVGGPILDAVLGRLAPQARVVLCGVISSYLTGDHPGPANYVNLLSKTALMQGFNALDQWGRFDEAFAALRKWEAEGRLHHRQTIFEGIESCVDALNGLFTGVNIGKTLVKLSEPGAG

SEQ ID NO: 5252 - protein, 273 aa, Mycobacterium paratuberculosis
MDRRSMMLMSGIGMLGAAMRLPGAWATPPAPEAPPSAGGGPYIFADEFDGPAGSPPDPGKWTIQTWQDDVFPPVAGIYRDDRRNVFQDGNSNLVLCATQEMGTYYSGKLRGNFRSMINQTWEARIKLDCLFPGLWPSFWGVNEDPLPDGEVDIFEWYGNGQWPPGTTVHAASNGKTWEGKSIPGLVDGNWHTWRMHWGEEGFEFSRDGAEYFKVPNKPIHVAGGAPDDFRWPFNNPGYWMTPMFTLAVGGVGAGDPAAGVFPSSMLIDYIRIW

SEQ ID NO: 5253 - protein, 541 aa, Mycobacterium paratuberculosis
LYPIDASGSIDRSYVRIPGCPSPPGGPTGVWQHGGVSSPTRPAVPAALDPWIVAALAAAVSLAGAARPSFWYDEAATISASYSRSLTQMWHMLGNVDAVHGLYYLLMHGWFRLVPPTEFWSRAPSGLAVGAAAAGVVVLGRQFSSRTVAVVSGVFCAVLPRTTWAGVEARPYALSMMAAVWLSVLLVFAARRQSRWPWLCFGLALVCSVLLDAYIALLLAAYAVFVGVCCRTRTVLWRFGISSAVAVGVLLPFLLTVAGQAHQISWVASIGHRTVEDVVMQQYFERSPPFAVLSALLICAAIALWLSRSAPPGPSERQLLVLATCWVGIPTAAIVAYSALVHPIYTPRYLCFTAPAMALILGVCSAAIAAKPWVTTAVVGVFAIAAVPNYVRAQRNPYAKYGMDYSQVADLITAKAAPGDCLLVNDTVTFMPAPMRPLLAARPDAYRKLIDLTLWQRAVDRNDVFDTNLIPEVVAGPLSHCAVLWIITQADPSEPAHQQGPALPPGPVYGATPAFAVPHDLGFRLVERWQFNLVQVFEATK

SEQ ID NO: 5254 - protein, 101 aa, Mycobacterium paratuberculosis
MDPLASIGYNGQPVRSPFRVVRPPIAVLVDLTVLFPRQPHRSGRYQPNGLQLHKVVEGRLSCWALCEQGDWWGLVTYPVAYGAKCRTVTHWVPAWTLRRKG

SEQ ID NO: 5255 - protein, 224 aa, Mycobacterium paratuberculosis
VEPSWASVLSKLVALAAVIALSPITVIPAVLVLHAPRPRPASLAFLGGWVLGLVGLTAAFVGGSELLSGLHATPPKWASWVRLVFGVALLALAAYHWFTRHRQRSMPRWMRSFATLSPVRAGVVGAVLVPLRPEVLILCAAAGLAVGNSSLSAGAQLVAAAIFVVLAASTVAVPILAYAGAGDRFDDALERLKAWMEANHDAMLAVILLLIGLIVLYNGIRALA

SEQ ID NO: 5256 - protein, 229 aa, Mycobacterium paratuberculosis
VAGLPLMAGSWGTVLTGLVPLGLVISLSPLTVIPAVLVLQAPRPRPSSLAFLGGWLLSLAALTALAVAASHLLGGLDRSPPRWSSWLRVVLGAGLIGYGIFRWHTRHRHSESPAWMRSFASITPARAGITGAVLAVVRPDVALICVPAGLAIGSSGLGPIGDWMAALFFVAVAASSVAIPILAYLAAGSRLDDALARLRDWMDRNNAALLAAVLVVIGAMVLYHGIDAL

SEQ ID NO: 5257 - protein, 260 aa, Mycobacterium paratuberculosis
MDAQGYCARWRQNADRRGVAARVVDEIVRRHGITPARFAVLETLTEFRDPLGKSYFLLRPDTPGEHAREAVLMTYILNAGTDYGIGKAPTDFPPTPYSAAEAVRIIARQHANDWSYRRDVRFVHRNGARLVTTPNGMLMGLGGNGIQRLFSARGGTTWGDIFMVNLGRLADPVDQLHRIIRSGRAWGRDAHGVPRAAHLDLDRLLHHEERHAAQWAARGYFGMLTGYGRELFRELVFRVVNRFEEDAGLCDGGYRASIPW

SEQ ID NO: 5258 - protein, 467 aa, Mycobacterium paratuberculosis
VKLNAHNLTGLKIPVPTYDRSQIGIGIAHFGVGGFHRAHQAMYLDRLLNDGLARDWGICGIGVLPDDRRMRDALRSQDYLYTLILEHPDGTQEPRVIGSIVDFRYAPEDPGSVVDLLADPATRIISLTITEGGYQPPLSAAFELVAEALNRRRERGLPSPTIVSCDNIIKNGDVARRAFTAHAEQVNPELAQWIRENTTFPNSMVDRITPTPTPDLVDRLAAEFGVQDAEPVVAEPFAMWVLEDDFADGRPPLDKAGVRLVDDVAPYEAIKLRLLNAGHQGLCYFAYLAGYREVHEAAQDPVIAEFLARYMDSEAMPTLPRMPGLEDFRDGLIPRFANAYVGDQVARLCADSSDHIPKWLLPVVHDNLRSGGPVQLSAAIVASWARYAEGVDEQGRPIEVVDRLADTLVPLARSQRENPDAFLANRAVFGDLIDAPRFREAYRWALDSLHRRGARATLRALIGADGS

SEQ ID NO: 5259 - protein, 144 aa, Mycobacterium paratuberculosis
VFARRFFALLCQSASSASGTDEGEGWMAARRLVGRVTGAALTAGPLVLAGMLTATVTAGPARADQAAFLNDLHNAGIHAVNGGDDALLQMGADLCQQLSWGASPQQLEGLALQRSDADQGTGGINGRQAADVVIFALRDLCPNA

SEQ ID NO: 5260 - protein, 183 aa, Mycobacterium paratuberculosis
LTLMAIVDRFNMKVVASAGLCGAAIALSPDAAAAPLITGGHACIQGQSGEVAPAAGGPVAGGAPAAGGAVAAGATDMCAAPLTDMSGVPMAVPGPVPLGAPVPVPLGAPLPLGAPVPLAPPVPVVPAGAPLIALGGPAAAGAPVEAAAPLIDMSGVKDAPTGPAPTGGPVPGQPVRPGPSGAS

SEQ ID NO: 5261 - protein, 271 aa, Mycobacterium paratuberculosis
MRTGVRCVLATVGVAACVVVTPAGVSLAAATQSHAFAIASVLPSSGEMVGVAHPVVVTFRAPITDPAKRHAAEQTIDVKSTPAMSGKFEWLDNRVVQWVPDRYWPAHSTIALTVGGVSTEIKTGPAVIGVASISEHTFTVSIDGVEAGPPTSLPAPHHRPHFGEQGVMPASMGRPEFPTPVGSYTVLSKERAVTMDSSSVGIPVDDPDGYLLTVNYAVRITNRGLFVHSAPWAVRSLGLENVSHGCISLSPDDAEWYYDHVNVGDPVIVQD

SEQ ID NO: 5262 - protein, 101 aa, Mycobacterium paratuberculosis
LDTRKRRCGALGDGDPYEQMRERKALRPREYDVIRLLRPLPEHNLPAGSRGTIVMDYTKDSDSTLPSAYEVEFSDVDGVTQALVTLSGDDLEVVWRPDPDA

SEQ ID NO: 5263 - protein, 493 aa, Mycobacterium paratuberculosis
VGARGLPSPPTGTRGDSCFFEWSSAARLRCRPVSLFGNLEPRVSGLLLAECLGHARRTRGLTADLEKLWKVIGLSEQDTVRVVMEPTRNAWVALASWFRHHGARISMVPTTQSADLRAYYSKHTKNDHLDSKLLARLPLLHPEGLRDHSGDGPGEPLRRLVKIRSSIVKRRTAVFQRLDAQLELLGPAWYDALGSSYGKAALALLARYADPHSLIRLGHARLTRFLIRHSRGAWREPHATLLLTAAQESLQLWGSGANARIDFAELAADIATEAEQAQMLTEQIDDLDERAANLYAEADPRGIIASAPGLGPVTCAVIAGRIGDPHRFHSLAAIRAYSGLVPKVSQSGQAEQRHGLTKAGDPLLREALFAAADQARKTDPQLAAKYKRLMTTERHHDSAICHIATTLLTRIATCWRTGAHYVLRDTDGRPITFEEGRRIVRAHHAVDKKTRINAASKRYSQRQKGRTGREPQESPSAPIHRPVHPSIKPTEVA

SEQ ID NO: 5264 - protein, 284 aa, Mycobacterium paratuberculosis
MSVAVPIVSVMPALDPRERVERFVLRARKVMAHSLVRDRSDLLKELASGTIKVQIQVDTVTGEATHQFSMELPPEEAFESFAARVRPFTIPKEPVYWAVVLDALEELVSEDTLANIIDIEDLRAHWKTVVEGKKVAQAFYVVTEKGQLSDVQLAEMWLNSDALHTQLIQSEVGKELSLDQRYRAATGVYARLGSCVNATHYLVKYLVEEGLLELDPEVFTLPVLAKTSVEIKGAVYSAELGAEMPTDLSNLDPEVWRPIHKDIDLLASSEHGSPEDGSSREPEE

SEQ ID NO: 5265 - protein, 80 aa, Mycobacterium paratuberculosis
LSPQQSFRSLRYTYASLCLAARIRPIDIAELMGHRDVKTTLTVYAHLINTDDHTGNMAALGSLAAPLQKPNYGNVIPLHG

SEQ ID NO: 5266 - protein, 312 aa, Mycobacterium paratuberculosis
MTSEDHTAVATDTLTRSPSQTDARWQVLRASCWVLLVLTLLAAVVMAVRPSLAAQAGAAQMGFLILFVVVHAWLGYSARGMAAFVAIAGIVAFALEAIGVATGFPFGSYTHHLPGPKPLGVPPVAIASWIIFGWLAWALARVIMRPVPGVAVGGAERFTTPIVATLILGGYDLVYDPIGATAHDWYSYDHPTGALGVPLSNFLGWLLTGWLIFQLVALVEPRFPGSPVTRTRTYWLLPCLFWLSTTTQIFTSLIHPPDGFAVRGGKTIQLADVYESGASAALFTIVLTGIMALVRLYRRQASKTLRSSADEA

SEQ ID NO: 5267 - protein, 432 aa, Mycobacterium paratuberculosis
MRTPVTVGQHRHPFGRDIYVGRSGYVTEDAISIGGVNLADPDTYRAGMPYGAFRKLRERAPVAWHPQKDGSGFWALTGYEEIHAVSRDSATWSSQINGAMFDAPPPGEVPPVMIFMDPPQHTALRKLINKGFTPRQVTRLNEHIVEMAKQIVDDVIERGECEFADDVAGALPSYVIAEMLGIPLEDGRRLYQITEILHTGSVGDSDDERQQAMVEMFQYGVELAVRKRAEPGDDIATSLLHAEVDGQSLSDLEFNLFFMLLIDAGGDTTRNLVAAGILALLEHPQELQRLKADPSLMPTAIEEMLRYTSPVTAFLRTATKDTELRGVPVKAGERVAMFYPSGNRDDSHFADPDRLDVGRAPNPHLAFGGGGTHFCLGANLARVEASAMVPEVLSRMNDLELAGPVERLRSDLINGIRSMPVRFTPGKRLGTA

SEQ ID NO: 5268 - protein, 211 aa, Mycobacterium paratuberculosis
VGRHALARKRRKPSATLAAVLAPAAVFFAVSADVHPFAERETAKPVINEPAPCCAEIVTLASTRLSKGFGDGQPVAASRYHTRSRFLPAGVAPERGLQVRTILTARSISAEFPQIHEIGGVRPDPLPWHPLGMAIDVMIPDPESAQGIALGNAIVAYVLQNADRFGIQDAIWRGVYYTPNGAQTSRLGHYDHVHVTTIGGGYPTGDEVYLR

SEQ ID NO: 5269 - protein, 190 aa, Mycobacterium paratuberculosis
VLLSDRDLRAEITAGRLGIEPFDDALVQPSSVDVRLDCMFRVFNNTRYTHIDPAKQQDELTSLVEPQDGEPFVLHPGEFVLGSTLELITLPDDLAGRLEGKSSLGRLGLLTHSTAGFIDPGFSGHITLELSNVANLPITLWPGMKIGQLCILRLTSPAEHPYGSTRVGSKYQGQRGPTPSRSYQNFITST

SEQ ID NO: 5270 - protein, 690 aa, Mycobacterium paratuberculosis
LEGFVLNIVLGVSMAPSSIQMVVLEGEYADGATVEEDAIDVTGADDAATASAPDRVISAILGTREGAADAGLQLSSIGVTWTDQLEAAALRDALAARRIDNVMLVSAFLAAAALAQNVGGAMGYERTAVLLVEPDTATLAVVETSDGSIPDVYKQQIRAESYGDAAGQLSAMVAGLEKLESLPGGLLLVGSGVDVAPLKQVLQTTTFLDVSVAEEPETALARGAALAAANAPLFASSTAALAYAQDPGTGAVDQYSLPDYLYVPVGPEPGDDELAYSAVGDEDAESPTVVIEKLFLPEDSEPRRRPVLLVGSGLAVVGISAVLALEIALAIGIRTTGTVALQPTPNQHLIVPTEQAPAPPPVQASAPQPKISVPEPVAAPKPLSLPVAAPLPAAPPPAAPPLPEAPPIPAAPPVVPVPVVVPPVPVPVPVRIPVPDPVSPPQLLAPPRLSVPQPVQPPVRVPQPPSPPQVGGTVPQSPPQHQTPPGEGTPPKPDSPGNYGGGHAPTPGAGGSGGSGGGHVPTPGAGGSGGGHVPTPGAGGSGGGHVPTPGAGGPGGTGGSGGGHVPTPGAGTPGGSGGGHLPIPGAGSTPGGSGGGHLPTPGAGTPGGGLGGFGGGHAPAPGGGLGGFGGGHAPAPGGGLGGFGGGHAPAPGGGLGGFGGGHAPAPGGGLGGSGGGHSGGGLGGLGGGHK

SEQ ID NO: 5271 - protein, 512 aa, Mycobacterium paratuberculosis
MLPGGRVGQRSKWGRGLEAVAGIVLGVAMTPTKVRMVLVEGESADGVTVDEDDFDVDTRRTALPGTAPDQVISAILGTREGAADSGYQLLSTGVTWTDHVEAAMLRDALIAHKVENVMLVSAFMAAAALTQAVGDATNYARTAMLFVEPYSATMAVVDTADGSVSEVRRRPLPEDEDQAVAELVDMAASAESLPTRPEGLVLVGSGVDVPLIKPALEAATSLELSVPDEPEMALARGAALASANAPLFASSTAALAYALDPGTGEVDPLALAGQSPGLLPGYQPEYHSRIAAQAADAGEGKANVAYSAVPDDDAEAKTLIDLDERARRRKSLLLVSSTLPVIFIAAVVALGDRPGDQHPAHRRVAAQPQREHHRPRPGAAPARATGPGAAEDHAAAAAGRAAPDRTTAPGPAAHRRPRSRPFAAGVRSAAARAARPPTRARSRPLRRPRPVRWGPRSLRRARSVRRPRSLRRGSRPVRRAWSLRRRPRVRRRARVRWRPRPPVARIPARLRV

SEQ ID NO: 5272 - protein, 410 aa, Mycobacterium paratuberculosis
MAAARTLSKSRLTLKSRAPTRLRSHPAQQPTFGRFGGAVDVVLGVSMAPETVRMVLVEGESAGGLTVDQDGFDVTADATPAAAANHVVAAILETRDSATQGGYRLKSSGVSWTDPVKAAALRDALAARKIENVMLVSAVMAAAALAQAMGSATNWARTALLLVEPTSATLAVVDTRNGTVTDVHRHPLPGHDDAALAKLTAMVSGAESMRSRPDGLFLVGSDVDIPAIKPTLEAATSLSVTTPEEPEMALARGASLAAANARLGAPRTVEMAPTHLSSTATAPPAAELAYSADTHDDPASEPTREGRSPKSVATIAAVAVIFVGGIVALAWALAFIRPHADQRPEVGTQVVAPDNPPPPSAAPSPPPAAPVPAAPPPQAPVSPAPSPHSGDHEHWDDWLHRHLGPGVPVP

SEQ ID NO: 5273 - protein, 448 aa, Mycobacterium paratuberculosis
LDTVLGVSMAPTAVRMVLVEGENGDGATVDEDNFDVATSEDAATVTASDQVLSAILGTRQGAAEGGYQLASTGVTFTDPVEAAALRDKLAAHKVENVMLVSAFLAAAALAQAVGHRTNYAHTALLYIEPDTATLAVVDSADGSIADVRRQPLPEDDEAAVAELASMVSNAENLETRPDAVFVVGSGIDIPLIKPALEAATTLPLTAPEEPDTALARGAALASAHAPLFASSTAALAYAQDPGTGAINPLAVAPGYFETPADAGADGLAYSAVPDDPDEFFTGTQAAATELVDADYADRSSFKLVGSAVAAIFVIGVVALVVSLAIAIRPTANVRPSPNQNVVVAPTRPAPAAPAPAPVQVAPVPVPEAPAPAPAAPPPPPPAVAPIPVPIPLPIPGLGGPGFGGPPGHGGGDGGGHGGGGFPGFPGGGGHGGGGFPGFGGGHGGFGHH

SEQ ID NO: 5274 - protein, 441 aa, Mycobacterium paratuberculosis
MRCTVFGTGYLGATHAVGMAELGHDVLGVDIDPGKVAKLAGGDIPFYEPGLRKLLNENLAAGRLRFTTDYDMAAGFADVHFLGVGTPQKKGEYGADLRHVYAVIDELVPRLTTSAVLVGKSTVPVGTAAELNQRAAALAPRGVDVEIAWNPEFLREGYAVQDTLRPDRIVLGIKQDSPRAQAAVRELYGPLLDAGVPFLVTDLQTAELVKVSANAFLATKISFINAISEVCEAAGADVSLLADALGYDPRIGRQFLNAGLGFGGGCLPKDIRAFMARAGELGADQALTFLREVDSINMRRRTRMVELASAACGGSLLGANVAVLGAAFKPESDDVRDSPALNVAGQLQLNGAAVNVYDPKALDNAQRLFPTLNYAVSVEEACERADAVLVLTEWRQFVEMDPDDLADRVRARVVVDGRNCLDVTRWQRAGWRVYRLGAPRP

SEQ ID NO: 5275 - protein, 274 aa, Mycobacterium paratuberculosis
VAPARERHAGVTLGAERERSLTGVDYAGAFLDENRAFAELFRDADESTPVPTCPDWTLRQLFRHVGRGDRWAAQIVRDRLDSYLDPRMVEGGKPPPDPADAISWLHGGAQRLVDAVELTGVQTPVWTFLGPRPANWWIRRRLHETAVHLADAAIALGREFTLRPELAADAITEWLERVAVQAGGQGAPLPLDNADTLHLHATDPGLGDAGEWTVAVEQGRIAWSHEHGKGSVALRGGATDLLLAILRRRPLADTGAELFGDDAVWQRWLDRTPL

SEQ ID NO: 5276 - protein, 116 aa, Mycobacterium paratuberculosis
MTTSEIATVLAWHDALNASDLDTLIALSSDDIEIGDAHGAAQGHEALRNWAAARRGTAELGRMYVHDGVVSSNRRSPAPTTRAPSARPPRRSASCTTGSRRCSGTTAWPRRWRPPN

SEQ ID NO: 5277 - protein, 291 aa, Mycobacterium paratuberculosis
MRGIILAGGSGTRLHPITTGISKQLLPVYDKPMVYYPLSTLMMAGIRDILVITTPHDAAGFVRLLGDGSQFGINITYVTQERPDGLAQAFVLGADHIGNDSVALVLGDNIFYGPGLGTSLRRFQTITGGAVFAYWVANPSAYGVVEFSDDGMALSLEEKPKTPKSNYAVPGLYFYDNDVIEIAKGLKKSERGEYEITEVNQIYLSRGRLSVEVMARGTAWLDTGTFDSLLDASDFVRTLERRQGLKVSVPEEVAWQQGWITDEQLSERAQSLLKSGYGGYLLDLLERSRFH

SEQ ID NO: 5278 - protein, 454 aa, Mycobacterium paratuberculosis
VGAGPGRRDRAAGQLPGRLSTVSTQPGASTVERVTHSHSHGLPSGPAPVDRLPARIVVGLLIAIGVAVAAGAIVLWPSRQHVDIPMPLQNAAGGAVSTQAGHVLSSGLGDCGSPSVSQVLTGPPQPALPGAGRCVLTQVAIDSGPNAGAATLLESSPGPGQPKFAVGDRIRIVRQVDDQGATSYAFYDFERGWALVGLAVAFAVVIVAVARWRGLLALVGILVAFVVLVTFLLPALRDGAPAVPVALVAAVAILYAVIYLAHGVSLRTSAALLGTLSSLLLAAGLSWAAIQLAHLTGLSDEQNSTVSAYLGSVSIGGLLLAGFIIGSLGVLNDVTVTQSSTVFELARLGGSRRAIFTGALRVGRDHIASTVYTLVLAYAGSSLPLLLLFSVANRSLTDVLTGESVAIEIARSAVGGMALALSVPLTTAIAAVLAKPSGGRKRGEAGRGGPPPSV

SEQ ID NO: 5279 - protein, 430 aa, Mycobacterium paratuberculosis
VDSDGTIGGVTTHQLPVHSSAHHRQQRTFAQSSKLQDVLYEIRGPVHQHAARLEAEGHRILKLNIGNPAPFGFEAPDVIMRDMIQALPYAQGYSDSQGILPARRAVVTRYELVDGFPRFDVDDVYLGNGVSELITMTLQALLDNGDEVLIPSPDYPLWTASTSLAGGTPVHYLCDETQGWQPDIADLESKITERTKALVVINPNNPTGAVYSGEILSQMVDLARKHELLLLADEIYDKILYDDAKHINVASLAPDMLCLTFNGLSKAYRVAGYRAGWLAITGPKDHAGSFIEGINLLANMRLCPNVPAQHAIQVALGGHQSIEDLVLPGGRLLEQRDVAWSKLNEIPGVSCVKPAGALYAFPRLDPEVYDITDDEQLVLDLLLQEKILVTHGTGFNWPAPDHLRIVTLPWARDLAAAIERLGNFLVGYRQ

SEQ ID NO: 5280 - protein, 959 aa, Mycobacterium paratuberculosis
VTTQMLIRLVVGMGMTLIVAALAARRVLWLFKLITSGKPAPGHTDDPGKRVWAEVSEVFGQRRLLKWSIPGLAHFFTMWGFFILLTVYIEAYGLLFQDNFHIPIIGRWDALGFLQDFFATAVFLGIATFAVIRLMRSPREIGRSSRFYGSHTGGAWLVLFMIFNVIWTYVLVRGSAVNNGTLPYGKGAFLSQLFGAILRPLGQPANEYIETAALLAHIAVMLAFLIIVLHSKHMHIFTAPINVVFKRLPNGLGPLLPIEYDGKPIDFENPPDDAVFGRGKVEDFSWKAMLDFATCTECGRCQSQCPAWNTGKPLSPKLVIMDLRDHWMAKAPYILGDKQSPLESTPEGGVGEELSGEKHAEAHHVPESGFGRVMGSGPEQATRPLVGTEEQGGVIDPDVLWSCVTCGACVEQCPVDIEHVDHIVDMRRYQVMMESEFPSELSVLFKNLETKANPWGQNASDRTNWIDEVDFDVPVYGEDVDSFDGYEYLFWVGCAGAYDDKAKKTTKAVAELLAVAGVKYLVLGAGETCNGDSARRSGNEFLFQQLAAQAVETLDGVFEGVETVDRKIVVTCPHCFNTLGREYRQLGANYTVLHHTQLLNRLIRDNKLVPVTPVSQDITYHDPCYLGRHNKVYEAPRELIGAAGANLTEMPRHAERSFCCGAGGARMWMEEHIGKRINHERVDEALATGAATVATACPFCRVMVTDRVNDRQEEAGRSGVEVLDVAQILLGSLEYDKASLPEKGTAAKEAEKRAAQAPKATATVEAPAKETTKEPAEAAPKAEAAPAAPAAPVKGLGIAGGAKRPGAKKSAPAAEAKNEAPAEAKTEAPAAPAKGLGIAAGAKRPGAKKSAPAAQAPKTEAPKTEAKTEAASEAKTEAPAAPAAPVKGLGIAAGAKRPGAKKAAPKAEAPKAEAEAAKAEAEPAPKAEPAKQTNGDDAPSQPPVKGLGIARGARPPGKR

SEQ ID NO: 5281 - protein, 565 aa, Mycobacterium paratuberculosis
VRDMSEPLGLSIGVANLVAARAGSVPVIRSSVLTLFEQRPTEVGLPDENPNLTEPGLVLRGFVERVGDRAPLVAADGTKYLGAALTVEAVEAMARAVGYGAPITIAVPAYWSDDQFAALREEFFAQSDLAREGVAPMLVSDATAALAMLRGTPGFPSDGVIALCDFGAGGTTVTLMDGRAGFAPVGPSLRYTDFSGDAIDQLVLDHLLASDVSTAMLGGSGRIGSQSRLLGACRRAKEQLSTAVAATVAGAPGQGAQLTRAEFEQLISTPLDRFLDWCQEALRRNGIGNSTLRGVAIVGGGASIPLLTARLSGRFGVPVHSTAQPGLSAALGAATLGAQYASGAAPTAAAAAAVETPTEMVGAGGLDMTQAAWAAQATDVDDALAWSQDADTSDEPVPYTGRDATGEYASEARRFDDAAAGGLPWYKRTALVLSVAGAGAAVLIALVLAINLLLTKSTQDRPTSPPSTPAPPQTVTITGPNDSTTVTVVPAPPPPSSEAPPPPATTTTAPPEPSTTTTTTTPPPSSTTTTSAAPTTTAQPSTTSAASTTTRVRPIPPIFQPPFGR

SEQ ID NO: 5282 - protein, 260 aa, Mycobacterium paratuberculosis
VPVADLVKSSSDEASYIVPERDSTHEPPDGCVGRHSRRREPTRYTGQDRRCAVRVPTPRLPIGISGLAGAVSTIGAVASNGPRDEFHNQLTQHADFGMSQQPPTGELPPPGFPPDRPEGFEQPGNVDPFDQQAEPTPWYRRPAMLIAWVVSVVVLIGLIVFGVIELIGGQQGVSHVPKSTTSTTTTTTTTTTPTTTTTTTTPSSTSPGSSAEQPPAQQPSQQPGGGQTQQPSHHHRLPQLPPVITIPQVPTVITVPPGLR

SEQ ID NO: 5283 - protein, 476 aa, Mycobacterium paratuberculosis
VRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 5284 - protein, 275 aa, Mycobacterium paratuberculosis
VTNVLRKFGGIATCVVFAVISIAGCHSGAHRSEASSTPATPPAGWPAALNDFTFVWTAEPGIDVTAGPAVPVRAYTESYLLASIMGDNRYLYPGFQQSVDPNQSINHPIGTQSLWPKTNAPQQQWIGTVQVHILSVTTADRDVTVVACEYTFGTAQPARNGYEPNIGKPPPYSGIDPLRITMKAPAKPGPESPQRGPARSPSVDVFNGWRITSHQGGYFAQSGVGDEWPNAIEDRNTCLAKAPQHPDLQRGGEYPRTDFPTLPPSPGWPAPSAAS

SEQ ID NO: 5285 - protein, 777 aa, Mycobacterium paratuberculosis
MQLKHLTIAELVAGAGGDPWEVNRTLQAGRPAQIERLAEAFHGAGRHTAESDHAFAQAQQRFNAAWNHQDGGPNPINSSAEVQRTVKSLGAQSEQLPKIGADLENIAAALSEAQKSGAAEIATLEGQLEQLDHMIDLAEQDLRDHPDAASQQELHAIIKALRTAAVNDTKDALGQLHATRDSYSSSLRKAQTNLANDGYDPTSTFGADAHEAETPDQARQDVTDALAGDKGAASRVNGVLNSITPDQLAGKVPLTAEQASVLSQLQAQEHGMSMDALKTAEQRLGDEKGVIGNSLQLMSNPNLMFPQTPLSIGAKQGTDMVKGGANQLPTSVQQLLNSPRPDLRHLNQLADIVKDGNHTFQANTDLDRGMVKQASTLMNSPFWRAGEGGPGDLNPGIDPTVSNVLSAASPDHQVVHDAMTTGDHDRFLQNLTHHSWQDHGQAVSSLFSWTGDATQGPEASIAAQTAHAYSTYIGHHQQDLLNLPGNHTLGQVNPNLVQGMAHGLGPYVDNIAGTTGGLPGFGDSLDNEGDTRSGALPVAKGVFSVLNSDQAAGQYFNGQAYAHAVAHEAAFGNEPTHSGYDTQLYDAATLKGLVDVGTHNAYHANEVNGYHQQLSEYELKKQAYEAGLTGLGTVAGLPPGVGTVANPALNVLGHGLENSILGPAPSAPGENPIQPMDIGVADQGMANAMLAAGHNVQLPDGYVVYDDQHPHGRLATLDEARAKFPGLTASQYDGVIGPALSHAIALPPEEKMSPDEWMAIRYDNVVGVPHADQGRPK

SEQ ID NO: 5286 - protein, 200 aa, Mycobacterium paratuberculosis
LSGERQVRLSENARRSLAGGALLLVVLPGGAGLVSGCSTVIGGRPVASPGAGPTEPSFPTPRSTPPSATAAPAPTALPPPSPSAPAGAIPLPPDQNGYVYIETKSGSTRCQINKDTVGCEAPFTNSPLQDGEHANGVSINAGGKVQWVLGNLGAIPTVKLDYRTYSAQGWTIVANADGTRFTNDQTKHGMFVSIEKVNTF

SEQ ID NO: 5287 - protein, 211 aa, Mycobacterium paratuberculosis
MLPEPPAPHILRSLGIGDDEMRAIGVDEIWWRVHRTAGEHVLAWNALRTFGPVLRFDPHPLPRGEHARHGVWYGASSPCAALGEAYQVDRTIDRERGRPYLTGLSFTRPLRVLDLAADSRGAWATRVGGTFAISTARHTVTQQWAQHITAAFPHLDGLRYNSRFAGDPCLVLFPPAASAMPARPRLSLPLAHPDLAGRVAGAAKRLGYGVV

SEQ ID NO: 5288 - protein, 201 aa, Mycobacterium paratuberculosis
LPMSTDELDQLLLDRFNLRRSDLIAALKTLSAHRPWAATLTTDEARLLDDAGFTEDPGAYAEIAADVTAHMARLYGTAYSAADVSKGLGVNDSRVRQRRLAHTLWAIDDGGTWVYPAIQFEIVDRGRDEPLTLKQVRGLDAVLPALLARDLHPTAVAGFLMTAQPDLRIDGQPKSVRDWLLHGESVGPVLELIEIADWTAT

SEQ ID NO: 5289 - protein, 623 aa, Mycobacterium paratuberculosis
MARAVGIDLGTTNSVVAVLEGGDPVVVANSEGSRTTPSIVAFARNGEVLVGQPAKNQAVTNVDRTIRSVKRHMGTDWSIEIDGKKYTAQEISARVLMKLKRDAEAYLGEDITDAVITVPAYFNDAQRQATKEAGQIAGLNVLRIVNEPTAAALAYGLDKGEKEQTILVFDLGGGTFDVSLLEIGEGVVEVRATSGDNQLGGDDWDDRIVNWLVDKFKGTSGIDLTKDKMAMQRLREAAEKAKIELSSSQSTSINLPYITVDADKNPLFLDEQLTRAEFQRITQDLLDRTRQPFKSVIADAGISVSDIDHVVLVGGSTRMPAVTDLVKELTGGKEPNKGVNPDEVVAVGAALQAGVLKGEVKDVLLLDVTPLSLGIETKGGVMTKLIERNTTIPTKRSETFTTADDNQPSVQIQVYQGEREIAAHNKLLGSFELTGIPPAPRGVPQIEVTFDIDANGIVHVTAKDKGTGKENTIKIQEGSGLSKEEIDRMIKDAEAHAEEDRKRREEADVRNQAESLVYQTEKFVKDQREAEGGSKVPEETLSKVDAAIADAKTALGGTDITAIKSAMEKLGQESQALGQAIYEATQAESAQAGGPDGAAAGGGSGSADDVVDAEVVDDDRESK

SEQ ID NO: 5290 - protein, 227 aa, Mycobacterium paratuberculosis
VTQGNQKTEGNPPEQVTVTDKRRIDPETGEVRHVPPGDTPGGTAPQAATAESGGAATDKVAELTADLQRVQADFANYRKRALRDQQAAADRAKAAVVNQLLGVLDDLERARKHGDLESGPLKSVADKLESALTGLGLTAFGEEGEEFDPVLHEAVQHEGDGSKPVIGTVMRQGYKLGDQVLRHALVGVVDTVTEEGDGEAAATDEPTAAAAETRPPESDDNAGASGD

SEQ ID NO: 5291 - protein, 392 aa, Mycobacterium paratuberculosis
MAQREWVEKDFYKELGVSSDASPEEIKRAYRKLARDLHPDANPDNPAAGERFKAVSEAHNVLSDPAKRKEYDETRRLFAGGGFGGRRFDTGGFGGFNVGGDGAEFNLNDLFDAAGRSGGTNIGDLFGGLFGRASGGRPSRPRRGNDLETETQLDFVEAAKGVAMPLRLTSPAPCTNCHGSGARPGTSPKVCPTCNGSGVISRNQGAFGFSEPCTDCRGSGSIIEHPCDECKGTGVTTRTRTINVRIPPGVEDGQRIRLPGQGEAGLRGAPSGDLYVTVHVRPHKVFGRDGDDLTVTVPVSFTELALGSTISVPTLDGKVGVRVPKGTADGRILRVRGRGVPKRSGGHGDLLVTVKVAVPPNLDGAAQEALEAYAAAERASGFDPRAGWAGNR

SEQ ID NO: 5292 - protein, 131 aa, Mycobacterium paratuberculosis
MAKNRKGHESRTFLISVAAELAGMHAQTLRTYDRLGLVSPQRTSGGGRWYSEHDVDLLREVQRLSQDEGVNLAGIKRIIELTNQVEALQARVKELTEELAQVRAGQRRDLAVLPKSTALVVWQPRKGGTRT

SEQ ID NO: 5293 - protein, 1425 aa, Mycobacterium paratuberculosis
VTDRQRELARLRAAVDAAARGGGECVLISGVPGVGKSALMKAFGVEVAGRGCVFAYGRCRDGAPAPYAAVRDALGSLVRTMAATAPAERDRWRADLAGGVSPIAGVLGELVPDLPRVLGETASHPELDATDSRRQLHRAATRLLSATASYRTVVLAIDDLQWADRDTLLLLAELLTVSLRDVLVVGAHRAGGFDPAAAGIAAENLTTIELEPLARDDVEELLATVCGKSGELPEVAAEFHHRTGGNPLQVRQLLYRAQREGALLPVGSGGPPRWDLRVLTSIEVSATAAEFLGRYLDQLRSADREVLSALSCIGGEFDLDDAAAAAARTPDVVAHALWACLELRLLEALDMTGQRISNAISRDARYRFSHDRVAEAARAGLSPDEMRAVHLRIGRRLITLGDDRLFEAARHVGVGGLAVADEAERTRFVEVLRRAAHQARAQASFPLALGYCRDALDLLGEQRWAGQFALTRELALDAADAALRVGDVPVLNALLEEAEEFLREPPDRARLAYLRMKGRVAENRLQEALEIGLAALDELGERVATQAGKPRMGNAIVRMRLTMARWSTERLLQLPHCTDQRVIALHPILAELCNMAVLVRPNLLPLLVRKQLELTLAHGHTSSSPLVITGYGIILVLLGDHAGSQRFGEVGMLLAQRPELREARPQTVFMYLDYIHHWRHPIRDGLGELRDAVEEALDRGDQENAGFLTAVLLSQSFWVGRPLPEIDALASSLIPHIRSQPVPSALCQAVQQLCLNLMGRSADPFLLAGESAYDERQVLPAARQQGDEVALGAAAAIKQGLHFWCGDHAGAAEATTEAIEHLGGLAGVAASQLVHLIGALSMIHCAPRDSATIRFVRQALASHRKWAAGAPENYAAPYALIQGAWARARGQHGKAERHLHQAIELAEEHRLPAIGARAHEEAAALYAETGRQTLREHMLRSAYQRWLNLGFAVRADWLAREHPWLLRRDLRTGSAGIDPIGAHQLVHALSGARTPDALANIILGSVADTTGAGRVLFITGEADNQSVRAIHDHGEVLIVEGPWTEVPYRRDIVRRVIDGGAPVSVAADRAAATNSVLAAPITLHDRTLGVIYAEQGEPGRNFGADHEEAIAFLCAQAAAPLWSFQLEARLRAADEYRQSLIDVQSRFVPNELLRILDIDDLRRVRNGHRVEREMTVLISDIRSYTAMIEDMNVAEAGNLAMGFLRAVELPIISYHGMIQDVRGDEIVAVFESEADAVRAGLGMLRSLHEHNQERRALGSEELRAGIGINTGAVAVGLVGGVNRMVLTIIGDAVNLAARIESTNKRYGSALLISDRTYQRIAGSEEFDVRRMERVMVVNRRRPVTIYEVYNGDSGPLRAAKRAAQPAFDEAFALFDAGDVDAARAAFQRCRDMLPDDPIAPLHLAHCDAVARGEMLPGQEIALQNK

SEQ ID NO: 5294 - protein, 268 aa, Mycobacterium paratuberculosis
MIWATGRRAAPMYLNAERLALANQTVKETFEQCSVAWQAIPHWDTGDPSQTTVPNDNVNPPNNFLPLTSLPKPFEVTLAAAIAPTPDELLATVVYYTAKLAADFDAAVIPGLLTATTPSQLVPGISPAQLLTALIEARAKVEKGGYRAPSCLITDTIGVETLAASTIANGYAGTDVLLPPANINSLQRVDTLATDPQVRGWLLGRRQRIAPGAAAEASPGEEAVDLAVSVPPSLEVVGDTSNNAIKLDVRLSYALRIKDEAGLVVFRA

SEQ ID NO: 5295 - protein, 394 aa, Mycobacterium paratuberculosis
MTSTLPDARPAVAALNPLEDYLAACKQACDREIVRLYGSGERGSNGLYQLILDYPLRGGKALRPALSIATCLGLGGHLEAILPTAATLELYHNAFLIHDDIEDESWWRRGKPTLHIDYGVPVAVNVGDAMLSLSLQPLLDNVERVGLGPALRILRAVATMTRKTVDGQALELDWVHSNTWRLDDADYLEMVELKTSWYSFITPLQAGTVAAGATPDRMAPLESLGRHLGAAFQITDDLLNLRADPQEYGKEIGGDLWEGKRTLMLLHTLRHAEPGDQQRAVQILSRRRPSPDAEFDLTELLDRLTAGGQLSVSGRTEIDARLRRHHHSEVKSLNDIRWLYELMHRVGSLNHARDVAVRQARQAAAVLAGLDWFPRSRHRDMLAALVDYVHGRAR

SEQ ID NO: 5296 - protein, 89 aa, Mycobacterium paratuberculosis
MTLTDPRDALADQSDFIGYLVGLAGLADVVHTLAGDGPRAAADPRAPDDFVHLLLGVASVGAGIARLADSTVAQSFPAAGMASTARWLR

SEQ ID NO: 5297 - protein, 343 aa, Mycobacterium paratuberculosis
VVAMSTVLARSDFLRAPMLATARPAGFKEWHHFVVHGRGVRLLINFSFNNEAFGADGARLTPRVIVIARDERWTGAVARFDERAVHVSADLGELSVGGNRMTIVPDGYRVAIDLPDKDIHGELHFTSTSRPFVVRNEPAGEGRVSWLFVPRLRADGWLRIGGADHRVCDDLAYHDHNWGRFRWGDDFGWTWGTILPAEPDDPWSMVFAQITDRSRLRCVSRSLYVWHRDEPAAIFRHAAVRARTEGPLDRPADCTLPPPMRLLLDGEVPGVPERIEITATRAADTVRAEFRSRSYVRLAQPSETRLDRSTVLCETDGTVAASGTVRGEKFDFAGTGVFEFLHG

SEQ ID NO: 5298 - protein, 1026 aa, Mycobacterium paratuberculosis
MSEHIRTPASLARRPTVAVLGAGIAGLTAAHELAERGFVVTVYEAQQDERNGLGSEPAGAYPPVKLGGLAASQYSTVGTHDGSHAELRPFPGRPSRPTDLGRAVAGEHGFRFFPAYYLHIWDLFQRIPVYELRNPGGWAPTARTVYDNVRRVITQGVTIDGKPSLVFPRELPRSGAEFLGILGQLATVGLTFGDVATFQGRMLRYLVTSPLRRARELQNMSAYDFFVGHDRRTGLNQYSYTPRCDALLRQMPKVLVAFDSRWGDARTNISTYLQLYLNMDRRDDKADGVLNGPTTESWFDHWYRHLVALGVRFVRAAATRLDPVPVDPSRPPHLRPRVQITLTDGTRVTPDYIVVAVDAPGAEFLTAPMRAAGTGGTVAGLDGFATSVPPPDGPLQPQSTRPRQRRDPYSMDELGRVPWDRFQTLCGIQYYFDTEFQLLRGHLLYAGTEWALSSINQTGMWERPPILDRDGHVSVLSVDIGDFNAASSHLVDESGRGKAARDCTPDEIATEVWRQIVAALTSSTGPAGEEFMPRPVWYALDRGLIMESGPGQGRGRAVRNATPYLVPIVGDWDNRPSSDPWNPHGTSWSSVPPEDWWLEDLWRRNVWQARHGGYQVHNNAVVFAGTWNKTFTRLTSMEAACESGRHAVNAILDHYIWVQSGGLDRREKTTLSWEFPFGFLDQGLSSPIRMPTPAGDYCYVFDIENREPADTRALRILDSRFCEWSLPHPLDVGAPTSFIPPPAGGQEMFGPTTDYNQQLLAYLQAWRELLERWTAMSAATPSPAAPFTPPAAPFTPPFMPPAAAPAPMPPAPADYTQQLFGYLQAWRQYLEQMAGASSGSAQQPTAPPTAPPTMPPTMPPPPPPPSTPSTGGQAFGAAPPGQPGTSGDPTPGGSTPVSATAKGSTLTWPPPLLGLEPSSYVGTQDPPVSRFLPPNLVNRAEDRQEVLLRPNDEYGYLHDLFSLNPGLARAISSTGPAPVASGSSFLGAMNRVGPDVSARVAPRSLFSSRAARAPSAGAITPGSRTG

SEQ ID NO: 5299 - protein, 316 aa, Mycobacterium paratuberculosis
LQPNVFSMTPCRGELAMDVVALRDPVSSVVARFVPRAGMIGTSLRDGEVELLGQRRGLDAYVADGKTMGIPILYPWANRLGGNTYAAEGAAVTLTPGRNGVRADPNGLPLHGVLAGYPGWRVTAQTANELTAQLDFGADPKLLAGFPFPHLLQVAVRLAGRTLTLTTTVTATGDTAVPVCFGFHPYLQLPGVPRAEWVIETPPLRHLGLDDHGLPTGESELQPARREPLRDKTFDDAYDRVDEGAVFAVSGGGRRLEVCFEHGYPAAQIFTPPAKPGEEAVICFEPMTAPTDALRRGGYRRAHPGRRAATRFSIRV

SEQ ID NO: 5300 - protein, 393 aa, Mycobacterium paratuberculosis
VSLEDAEALRVLRDAFAPCDAGRPGDSGDLVHRFYTHWFALDPSVRDLFPPEMGAQRVAFGHALHWVYGELVARRAQEPVAFLAQLGRDHRKYGVLPRHYQTLSRALLATLRSHLDAAWTDAVEDAARTSLNLITGVMSGAADADEGPAWWDGTVIEHLRVSRDLAVVRLRLDQPMPYHPGQYVNVQVPQCPRRWRYLSPAIPADPGCGIEFHVRLVPGGLVSTAIVNETRPGDRWRLSSPHGGLRVDRDGGDVLMVAGSTGLAPLRALIMDLSRFAVNPRVHLFFGARYRCELYDLPTLWQIASHNPWLSVSPVSEYRADPPWAADYPDVTPPRGLHVHQTGRLPEVVTKYGGWGDRQVLICGGPRMVAATKAALIAKGAAAQRIQHDPLSR

SEQ ID NO: 5301 - protein, 195 aa, Mycobacterium paratuberculosis
LSGCSTPSRLSLFRSTLSSFGRPGVRGTRRAMTQTTQPLMRTQVRADIPDSERDPARARRGGKRVARLRAGAVCWLAIAVCCLAAAGLAATGARTGLGGGSPAPVVPEAGTLQVSGAGTTKSLPCHAGYLSVSGKDNTVTLTGHCTSVSVSGNGNRIAVDSSDAVSAAGAGNVVVYHWGSPKVVNAGSGNVVRQG

SEQ ID NO: 5302 - protein, 848 aa, Mycobacterium paratuberculosis
VDSFNPTTKTQAALTAALQAASAAGNPEIRPAHLLMALLTQADGIAAPLLEAVGVEPATIRAEAERMLARLPQASGASSQPQLSRESLAAITTAQHLATELDDEYVSTEHLMVGLATGDSDVAKLLTGHGASPQALREAFVKVRGSARVTSPDPEATYQALEKYSTDLTARAREGKLDPVIGRDNEIRRVVQVLSRRTKNNPVLIGEPGVGKTAIVEGLAQRIVAGDVPESLRDKTVIALDLGSMVAGAKYRGEFEERLKAVLDDIKNSAGQIITFIDELHTIVGAGATGEGAMDAGNMIKPMLARGELRLVGATTLDEYRKYIEKDAALERRFQQVFVGEPSVEDTVGILRGLKDRYEVHHGVRITDSALVAAATLSDRYITARFLPDKAIDLVDEAASRLKMEIDSRPVEIDEVERLVRRLEIEEMALAKEEDEASKERLEKLRSELADQKEKLAELTTRWQNEKNAIDVVRELKEQLETLRGESDRAERDGDLAKAAELRYGRIPEVEKKLEAALPQAEARENVMLKEEVGPDDIAEVVSAWTGIPAGRMLEGETAKLLRMEDELGKRVVGQKRAVQAVSDAVRRARAGVADPNRPTGSFMFLGPTGVGKTELAKALADFLFDDKRAMVRIDMSEYGEKHSVARLVGAPPGYIGYDQGGQLTEAVRRRPYTVILFDEIEKAHPDVFDVLLQVLDEGRLTDGQGRTVDFRNTILILTSNLGSGGSEEQVMAAVRSAFKPEFINRLDDVIIFHGLEPGELVQIVDIQLAQLQKRLAQRRLTLEVSLPAKQWLAHRGFDPVYGARPLRRLVQQAIGDQLAKQLLAGQVHDGDTVPVNVSPDGDSLILG

SEQ ID NO: 5303 - protein, 381 aa, Mycobacterium paratuberculosis
MAAGRLWFADAGGVRPRFVDQSIPRRRPRLTVEEREEIQDGVARSESIRVIARRLGRHPSTVMREIERNAICRGRYRARYRFGVRWRGGHDPRPRYRASLAHTRAHVKARRSRPGKLATNQLLHDEVQTRLNEQHSPQQIAWRLRRDFPDDAEMWVSQETIYQAIYVQGKGNLRRELHTCLRTGRALRKPRRRPGERRGHLRDMVNISERPPEVADRAVPGHWEGDLILGSTASGSAIGTVVERTTRFVMLLHLPDGHGAEAVQEAIVAKMAGLPATLRQTLTWDQGKEMANHAAIAAATELDIYFCDPHSPWQRGTNENTNGLLRQYFAKGTDLSAFPADYLDYVASKLNRRPRQTLDWKTPAEALDELLCKPFTPPAVA

SEQ ID NO: 5304 - protein, 290 aa, Mycobacterium paratuberculosis
MVPLWFTLSALCFVGAGVLLYVDIDRRRGRSRRRKSWARSHGFDYERESTDILKRWKRGVMSTVGDVAAQNVVLGQIRGEAVYIFDLEEVATVIALHRKVGTNVVVDLRLKGLKEPRESDIWLLGAIGPRMVYSTNLDAARRACDRRMVTFAHTAPDCAEIMWNEQNWTLVAMPITSTRTQWDEGLRTVRQFNDLLRVLPPLPEETPQEAPAAPRNSSPSRPLAPAGRAELPPRRAQQDVAGLLGPDVQPGRRAAEPVRRDQPRPEARPDTLRRPPPGGRNGHQATNYQR

SEQ ID NO: 5305 - protein, 257 aa, Mycobacterium paratuberculosis
MPRPVALITGPTSGIGAGYARRYASDGYDLVLVARDVDRLTALAGELRDRAGNIEILPADLGDAADRQRVAERLAAGVRVLVNNAGFATSGDFWHTDPALLQSQLDVNVTAVMHLTRAALPAMLDAGAGTVINIASIAGLLPGRGSTYSASKAWVISFSEGLSVGLQGTGVSVHAVCPGYVRTEFHARAGIDMSKSPSFLWLQVDDVVDQSLADIARGKVISIPGLQYKAIVAAERLIPRTLMRAITKRVGGGRGRT

SEQ ID NO: 5306 - protein, 179 aa, Mycobacterium paratuberculosis
VAEPELEELAELVRRLSVVHGRVTLSSGKEADYYVDLRRATLHHRASALIGRLMRELTTDWDYAVVGGLTLGADPVATAIMHAPGRPIDAFVVRKSAKTHGLQRLIEGSEVAGKRVLVVEDTSTTGNSALTAVRAVQQAGGHVLGVATVVDRATGAAEAIEAEGLPYRSVLGLADLGLG

SEQ ID NO: 5307 - protein, 303 aa, Mycobacterium paratuberculosis
LHCCARLLAIVACLLACVTACSNPHPAARPYGAQGARLGESLALLGWNMSVSNLRWDGDYVLVDVDASPASAKGPHAKPEDIRFGLYGALAHPMEATGLGSCDSTTTSLHDVPAPLSAPPDRLTGTVCLGPLKDRSQVRGVYGYSPRDRIPNSSSAYPVAFPVGLLPTNPNDSGGLAVKTASLSAWRADGTPVTKAQLGDPGAFTGNGYMLLGLEATAVAARYRDESVQRGGPMMLLASPTLPGRGLNPACAAYGSSVLILPDASLDAVHVNASLCTQGEINDALLYATLAIDGTHAGVWTQR

SEQ ID NO: 5308 - protein, 219 aa, Mycobacterium paratuberculosis
VDAAMSEPGPTEWSATPSAGVGPWRGELPDDPRYDPILLRDGDTRNVVDAYRYWSREAIIADIDRRRHPLHVAIENFGHDANIGSVVRTANAFAVHTVHIVGRRRWNRRGAMVTDRYQRLCHHDSTAELLDFAAAAGLTVVAVDNVPGAARLEETTLPRECLLVFGQEGPGITDDTRTGATLTVSIAQFGSTRSINAGVAAGIAMHAWIQQHADLSQAW

SEQ ID NO: 5309 - protein, 396 aa, Mycobacterium paratuberculosis
MHTRRRWAAGREAGSSGMDQLWANRAASCEAAVTQRHLRRLWGLPATQLGVVAWPPARRERLFGTWHYWWQAHLLDCLVDAQQRDPQPQRRARINRQVRSHRLRNNLSWTNSYYDDMAWLALALERAARIAGVHRRKALPKLANQFLRAWVPEDGGGIPWRKSDQFFNAPANGPAGIFLARYGDHLKRAEQMANWIDETLIDPETHLVFDGIKAGSLVRAQYTYCQGVVLGLETELAARTDGPARQRHAARVRRLVAAVAEHMAPAGVLAGAGGGDGGLFAGVTARYLALVATTLPGSVAEDVAARDTARRIVLASAKSAWDYRQTVDGLPVFGPFWDRDAQLPTAGGKQAEFVEGAVTASEIAERDLSVQLSGWMLMEAACNVSAESSHENRSAL

SEQ ID NO: 5310 - protein, 449 aa, Mycobacterium paratuberculosis
VSKVHPDAESALHGLLKDGITVAAGGFGLCGIPEKLIQALVDSGIKDLTIVGNNAGVDDFGMGLLLKGRQVKKVIASYVGENKEFERQVLSGELDLVLTPQGTLAEKLRAGGAGIPGFYTRTGYGTTLAEGKDTRVFDGVEYVLEEGIRADLAIVKAWKGDKAGNLVYRKTARNFNPMIATCAAVTVAEVEELVEVGDLDPDLIHTPGIYVDRIIQGIGYEKRIEFRTTSGGAALKNDSPIRERMAQRAAKELRDGYYVNLGIGIPTLVANFIPDDIQVTLQSENGLLGIGAYPSEDTVDPDLINAGKQTITSLPGSSFFSSADSFAMIRGGHIDLSILGALEVASNGDLANWMVPGKMVKGPGGAMDLVSGVKRVIVLMDHTAKDGSPKVLEQCTLPLTGKGVVDMIITTLCVFDVEPGRGLLLTELHPGVTVEEVRAKTGCDFTVAL

SEQ ID NO: 5311 - protein, 230 aa, Mycobacterium paratuberculosis
MSTAVTALPDILDPMYWLGADGVFGSAVLPGILVIVFIETGLLFPLLPGESLLFTGGLLAAHPNPPASIWVLAPAVAIVAVLGDQTGYFIGRRIGPALFKKEDSRFFKKHYVTESHAFFEKYGSWAVILARFAPFVRTFVPVIAGVSYMRYPVFLGFDIVGGIAWGGGATLAGYFLGNVPFVHHNLEKIILGILVVSLMPAFVAAWRGYRGRRRPTRTPERESERLPASE

SEQ ID NO: 5312 - protein, 293 aa, Mycobacterium paratuberculosis
MPNPPEPGRGGPPKRPGFDPRASRASDEWTPETGEEPDGGFDSSEDATESVPMVPSDAETETVVINKPDPPSGPQETPDGPQRERRFTAPGFDAKETTIIATTPEPATEAFVPPGQDNTTQFGVPPKAAVPQSIPPRLGGKLRTSRQINWGWILALVVIVLALAAIAILGTVLLTRGRHTNVSQEDQVRHTIGNFDAAIQRGDLTTLRSITCGTTRDGYADYDEHAWAETYRRVSAAKQYPVIASIDQVVVNGQHAEANVTTFMAYDPQVRSTRSLDLQYRDDQWKICQSASG

SEQ ID NO: 5313 - protein, 154 aa, Mycobacterium paratuberculosis
MVEVRPAGETSELQNRAMTPMGDLLGPDPILLPGDADAEAELAAGENPGIVAAAHPTASVAWAALAEQALADDRAITAYAYARTGYHRGLDQLRRNGWKGFGPVPYSHEPNRGFLRCVAALARAADTIGETDEYLRCLDLLDDCDPAARKELGL

SEQ ID NO: 5314 - protein, 298 aa, Mycobacterium paratuberculosis
MGAGHNHTPAETGDARLIPRMVMAAAILAAFFVVELVTSLLINSIALLADAGHMLTDVVAVFMGLAAVTLARRGSSSPARTYGWHRAEVFTAVANAGLLIGVSVFILYEAIQRLREAPAVPGVPMIAVALAGLAANFVVALLLRSHSSGSLAVKGAYLEVIADTVGSLGVLIAGVVTVTTRWPYADVVVAVLVALWVLPRAISLARDALRILSESSPTHIDVEELRAALGAVDGVTGVHDLHVWTLSPGKDMCTAHLISTGDSARVLRDARAVLSARGLAHATVQIDCPDDTECSDSF

SEQ ID NO: 5315 - protein, 260 aa, Mycobacterium paratuberculosis
VSFRAPQHESVRPSPIFLALLGLTALGGALAWLTGSSPRPLAYLGVFVFVIAGWLVSLCLHEFGHAVIAWRFGDRDAAVRGYLTLDPRRYSHPALSLVLPMVIIALGGIGLPGAAVYVQTWFMTPARRTLVSLAGPAANLVLAAVLLALTRAFFTADHAVLWAGVAFLGFLQLTAVLLNLLPIPGLDGYDALEPHLSPETQRALAPAKQWGFFTLLFLLLAPGLNRWFFGIVYWLFDFSGVPHWLAGAGNVLTRFWSRWV

SEQ ID NO: 5316 - protein, 231 aa, Mycobacterium paratuberculosis
MLGDKDIGCSPIGWAVTQQDRAAAVLQFGRRHGYRPLRGMPTHRVAGDTDVDAAIGPYRRLIVLGGDAELALVLTRLLRAERLDVEVAYVPRRRTRATRNYRLPTGFRAARRAARGAARRVPLIRDETGSAIVGRACWAAPGGQRWLHGEAVVDDTTLFDGDVTAVWIEPTAAMPGLRAAVAGRPWRRWVTGRAAQLGSTGATVLRDGVPAARPARRSAFYRNIEGWLLVR

SEQ ID NO: 5317 - protein, 313 aa, Mycobacterium paratuberculosis
LLRTPLCRAGAVLASVVLLCSASATASADESIVIDLVRHGQSVANAAGLIDTAVPGASLTQLGQQQAQTVAGVLAARGPVAAIFASQLIRTQQTAAPLATALGMNVQVLPGLNEIDAGIFNGQPQFSLGGLAYLLAPIAWMLGLRIVPMLAPGSADANGYEFRRRFDGALQTVYGSAAANAGGFGDVLQAVYAGAVTNPVRAANGRITGVAFSSEFAIGVGTMMTVKNPDPLLLLFDPLPNTGIVVIQGSPRDGWTLISWNGKPVHPGWSATRNGRGANGLCLMLDPSTPTGVCAAKPPGPASAPVTARPGLS

SEQ ID NO: 5318 - protein, 432 aa, Mycobacterium paratuberculosis
MPAIVLIGAQWGDEGKGKATDLLGGRVQWVVRYQGGNNAGHTVVLPTGENFALHLIPSGVLTPGVTNVIGNGVVVDPGVLLDELKGLEDRGVDTSRLLISADAHLLLPYHVAIDKVTERYMGNKKIGTTGRGIGPCYQDKIARIGIRVADVLDREVLTHKIEAALELKNQILVKIYNRKALDPHQVVECLLEQAEGFRHRIADTRLLLNTALEAGETVLLEGSQGTLLDVDHGTYPYVTSSNPTAGGAAVGSGIGPTRITAVLGILKAYTTRVGSGPFPTELFDENGEYLSKTGGEFGVTTGRRRRCGWFDAVIARYATRVNGITDFFLTKLDVLSSLETVPVCVGYRIDGARVNEMPMTQSDLHRAEPIYEELPGWWEDISAAREFDDLPAKARDYVLRLEELAGAHVSCIGVGPGREQAIVRRDILAARP

SEQ ID NO: 5319 - protein, 212 aa, Mycobacterium paratuberculosis
VTEPDPTELDPEYEHHGGFPEYGPASPGPGFARFVESMRRLQDLAVSADPGDDVWDDAAERVAALVELLDPFEADEGAAPAGRTPGLPGMGSLLLPPWVLTRYGPDGVEMTGHFSRFHVGGNHAVHGGVLPLLFDHMFGMISHAAGRPISRTAFLHVDYRKITPIDVPLLVRGRVTGTEGRKAFVAAELVDGDQTVLAEGHGLMVRLLPGQP

SEQ ID NO: 5320 - protein, 420 aa, Mycobacterium paratuberculosis
VTDGVTDGRDDETTALAVPRPAPADRGPAPADGSPAPADGRPAVMLLGSGDISRELAIALGRLGARVIAVDAHPQAPAHAVADQALVLPSTDAGELSAAIHRLRPDVVVSTTDAVAVPALEALDGTGAEPVPSARAVRLAADREGLRRLAADELGLPTAPFWFAGSLGELEAVGAHAGYPLLVKPVVGAVGPRQSVVAGREDIAAAWHRAVDGQPGARVLAETVVEVQFHVTLLAVRSEGAAGPAIEFCSPIGHRGAGGRVLESWQPQKMSPAAMDAAKSIAARIVKALGGRGVFGVELMVNDDEVYFADVTAHPGDSAWVTVRSQRLSAFELQARTILGLPVDTMMVSPAAARVVDSADPGDRAALSGALGVPESDLRVCGGGFRALATAPEVAAARERAGQVAARLTAGAGGVVGAGG

SEQ ID NO: 5321 - protein, 146 aa, Mycobacterium paratuberculosis
MSTERAHSYAGDVSPLEAWKLLSDNPNAVLVDVRTDAEWRFVGVPDLSSLGREVVFLEWNTSDGRHNPDFADQLRRQIEPAPAGQERPVLFLCRSGNRSIGAAEVATQLGITPAYNVLDGFEGHLDANGHRGETGWRAIGLPWKQG

SEQ ID NO: 5322 - protein, 408 aa, Mycobacterium paratuberculosis
MSQAGDDSVRTPPALPDGVSQATIGVRGGLLRSEFDETAEALYLTSGYVYESAAVAEQSFTGELDHFVYSRYGNPTVTMFEERLRLLEGAPAAFATASGMAAVFTSLGALLAAGDRLVAARSLFGSCFVVCNEILPRWGVQTVFVDGDDLAQWEEALSVPTAAVFFETPSNPMQSLVDIAAVTELAHAAGAKVVLDNVFATPLLQQGIPLGVDVVVYSGTKHIDGQGRVLGGAILGDRDYIDGPVQKLMRHTGPAMSAFNAWVLLKGLETMAIRVEHSNSSAHRIAEFLETHPAVRWVRYPYLPSHPQYDLAKRQMSGGGTVITFALDCPDDKAKQRAFEVLDKLTLIDISNNLGDAKSLVTHPATTTHRAMGPEGRAAIGLGDGVVRISVGLEGTDDLIADIDRALG

SEQ ID NO: 5323 - protein, 480 aa, Mycobacterium paratuberculosis
VELRWADRPPGTAEGTGMSRHRVVIIGSGFGGLTAAKALKRVPEGTQVDITLISKTTTHLFQPLLYQVATGILSEGDIAPTTRLILRKQKNVRVLWGDVSAIDLTARTVTSHLMGMDTVTPYDSLIVAAGAQQSYFGHDEYAAFAPGMKSVDDALELRGRILGAFEAAEVATDPAERRRRLTFVVVGAGPTGVELAGEIVQLAERTLAGAFRTITPSECRVILLDAAPAVLPPMGPKLGLKAQRRLQKMDVEVQLNAMVTAVDYMGITVKEKDGAERRIECACKVWAAGVQASALGAMIAEQSDGTETDRAGRVIVEPDLTVKGHPYVFVVGDLMSVPGVPGMAQGAIQGAKYAAGIIKQAVKGQDNPAERKPFRYVNKGSMALISRYSAVAQVGRVEFAGFIAWLAWLLLHLYYLIGHRNRLAAMFAWGISFLGRTRGQMAITSQMIYARPVVEWLERQAQDGTLAAAEHVDSAEKQAG

SEQ ID NO: 5324 - protein, 206 aa, Mycobacterium paratuberculosis
MSATARRIGALTALATLCAGTAPAAADPPPGLPPMTSGGSGPIIGGGSAAAQAISQQLFSFGNPGVVQEVDGSDAAQFITAAAGAANQQLAAPFSLLRRALTCQDNNAGFGARAYRRNDGQWGGAMLVAAKSATPSPDNLAACAKTNWRRATAGGETAMCNSGWTTPTSYESRRGETYYILLAGTAADFCSDLNAKYKSDATGWPF

SEQ ID NO: 5325 - protein, 220 aa, Mycobacterium paratuberculosis
MAVDYSELPAEEAVRAARAGARRRQVLDAAVKVMGRNGFHRMSMHDLAAEADVSVGLLYKYFGGKQDLLLATIVRILDVFRDQLAPVIDGAGDDVVDQLSAGIRRYIQIVDENLDGVVLTYRESRTLGAAGRAQIKDLEIATAAPLRAVIETGIAQGVFRSVDVDLAVFDIMLLAHGWALKHWHFGPIYTLDEYFALQTRHLLNGLISDERRADYADVLK

SEQ ID NO: 5326 - protein, 382 aa, Mycobacterium paratuberculosis
MAAHLQYTSEHHQFRELVRDFVQRTVVPNHEKWERDGQWDRSLFVEAGKLGLLGFSVPERLGGPGVDDFRYNAIVVDELQRAGAAAEAIAFSLQNDIVLPYLVELTTPEQQRRWLPGVVTGETVLGIAMTEPGTGSDLAGIRTTAVRDGDHYLVNGAKTFISNGQVGDLFVVAVRTAPDRHKGLSLLVVDADTPGFGRGRNLEKIGLHAQDTSELSFTDMRVPAENLLEAEGRGFYQLMKNLPQERLSLAVGAVAAAEAVFAETLDYVKQWHAFGAPIAAFQNSQFVLAELATEIDVARTYLDDCLAAHLAGELTAARAARLKWWTTDLQVRTADRCLQLHGGYGYMREYGVARAFVDARIQTIYGGTNEIMKTIIAKDLGL

SEQ ID NO: 5327 - protein, 398 aa, Mycobacterium paratuberculosis
MSTETSTKTPPSFDRYDPLGLDALLSDDERAVRDTVRGFCAEHVLPHVAEWFEIGDLPVRELAREFGRLGLLGMHLHGYGCGGASAVHYGLACVELEAADSGLRSMVSVQGSLAMFAIWNFGSEEQKRQWLPGMATGELLGCFGLTEPDVGSDPAAMKTRARRDGSDWVLDGRKLWITNGSVADVAVVWAGTDDGIRGFLVPTDTPGFTANTIHHKLSLRASITSELVLDDVRLPGEAMLPGATGLRGPLSCLSEARYGIIWGARGAARSAWQAALDYATQRTQFGRPIAGFQLTQAKLVDMAVELHKGQLLSLHLGRLKDSTGLRPEQVSFGKLNNTREAIEICRTARTILGGNGISLEYPVIRHMVNLESVLTYEGTPEMHQLVLGQAFTGADAFR

SEQ ID NO: 5328 - protein, 255 aa, Mycobacterium paratuberculosis
VNLDSSAMNTHSHRRLAVVTGAGSGIGRAIALGLAAGGDRVVAADLDEASAAATAAEQPDLITAAPVDVADPARVAALRDRIHADIGVPGVVVNAAGWDRTDQFLNATPEFAQKVVAINYLGPVHVCSAFLPGMIETHGGGRVVNVASDAGRVGSAGESIYAGAKGGVIALTKSLAREMARHQITVNCVCPGPTDTPLFHAQPEKLKEALVKAIPLRRLARPEEVAAAVLFFASQAASFVTGQVISVSGGLTMAG

SEQ ID NO: 5329 - protein, 123 aa, Mycobacterium paratuberculosis
MLRLRRLAWFAVDVLGVLVFCAVGRRSHDEGLSATGVAVTAWPFLTGTALGWLVSRGWRQPTAVLPTGVVVWLCTVIVGMLLRKASSAGVAASFVVVASTVTALVLLGWRVAAGLTLRRRSDA

SEQ ID NO: 5330 - protein, 296 aa, Mycobacterium paratuberculosis
MAATAEVGVTATLGAAARAVATRQGLLNDPYAEPLLGAVGIDYLTRAIADHTFAADESPVGDDPAVTSLLDALAAHTRFVDEFLAEAGRAGIRQVVILASGLDTRPYRLWWPRGTTVYEIDRPRVLDFKAGVLRGLDARLATNRCAVGIDLRDDWPAALRRVGFDAAQPTAWVAEQLLVGYLKPAEQNRLLRRLTAASAAGSRLAADHLPTWDPLQLEAERAFVEGWRRRGLDIDLASLTHLGEYHYVPEYLATHGWEPAARSIADLLGGLGLGPRRGAGSGGAQFIPEYVTATRV

SEQ ID NO: 5331 - protein, 172 aa, Mycobacterium paratuberculosis
MTPESSPPADGRLRFVPATHDDPLARPLLAELAVEYAQRYGGTPSAHLSWLPVPRDELAPPDGGLLIGVVDGVPVTGGAFRRYDAETAELKRIWTDAAHRRRGYARALLAALEERTRACGYRRLYLITGNRQPEAEALYDATGYTRVPPDPLPDWGPFRPIAFEKWLVPDER

SEQ ID NO: 5332 - protein, 247 aa, Mycobacterium paratuberculosis
MAELVQVTDAVHLARGDAVNWTLVADDTGVMLVDAGYPGDREDVLGSLAELGYGPGDVRAIVLTHAHIDHLGTAIWLASEHGIPVYCHADEVGHAKREYLEQVSIVDVALRIWRPRWAKWTAHVVRSGGLIRDGIPTARPLTAEVAAGLPGRPTPVFSPGHTNGHCSYLIDGVLVSGDALITGHPLLRHRGPQLLPAIFSYSQRDCIRTLSALALLDTEVLLPGHGDVWRGPIKEATDAALALATGR

SEQ ID NO: 5333 - protein, 336 aa, Mycobacterium paratuberculosis
VAELKLGYKASAEQFAPRELVELAVAAEAHGMDSATVSDHFQPWRHEGGHAPFSLAWMTAVGERTTRITLGTSVLTPTFRYNPAVVAQAFATMACLYPGRIFLGVGTGEALNEIATGYQGEWPEFKERFARLRESVRLMRELWRGDRVDFDGEYYRLKGASIYDVPDGGVPIYIAAGGPAVAKYAGRAGDGFICTSGKGEELYKDKLIPAVKEGAAINDRNVDDIDKMIEIKISYDPDPELALENTRFWAPLSLTAEQKHSIDDPIEMEKAADALPIEQVAKRWIVASDPDEAVAKVKDYVDWGLNHLVFHAPGHDQRRFLELFEKDLAPRLRRLG

SEQ ID NO: 5334 - protein, 695 aa, Mycobacterium paratuberculosis
LADISAIYVAAPEPETGKSTVALGLLHRLTATVAKVGVFRPITRDGQDRDYILELLLSRTTAGLSYQQCVGVTYQQLHADGDAAIATIVDAYHAMAELCDVVVIVGSDYSELGQAIRPAELSTNARIAVNLGAPILLTVSGKGRTAAEVATVVQVCLAELDAQHAHTAAVVVNRCEPAELDAVAEALRGFPQRCYVLPDEPLLSAPTVAELEKAVAGSPVSGEESLREREVTGILVAGMTADHVLERLADGMAVITPGDRSDVVLAVASAHAAEGFPSLSCIVLNGGFALHPSIAALVAGLRLRLPIVATALGTYDTASAAAAARGRVTATSQRKIDTALELMDRHVDIADLLEQLAIPIPTVTTPQMFIHQLTLQARADRKHIVLPEGDDDRILRAAGRVLQRRVADLTILGDEARIRQRSGELGVDLSDVKVIDPRTSALRPEFAQQYAQLRKAKGVTVEQAREIMRDATYFGTMLVYTSQVDGMVSGAAHTTAHTVRPAFEIIKTVPDVSTVSSIFLMCLPDRVLAYGDCAIIPNPTPEQLADIAISSARTAAQFGIEPRVAMLSYSTGDSGTGADVEKVRTATQLVRQRNPDLPVEGPIQYDAAIEPSVAATKLRDSPVAGRATVLIFPDLNTGNNTYKAVQRSAGALAIGPVLQGLRKPVNDLSRGALVEDIVNTIAITAIQAQGLPGGR

SEQ ID NO: 5335 - protein, 387 aa, Mycobacterium paratuberculosis
VDGSDGARRVLVINSGSSSLKFQLVDPEFGVAASTGIVERIGEESSPVPDHDAALRRAFDMLAGDGVDLNTAGLVAVGHRVVHGGNTFYRPTVLDDAVIARLHELSELAPLHNPPALQGIEVARRLLPDIAHVAVFDTGFFHDLPPAAATYAIDRELADRWQIRRYGFHGTSHRYVSEQAAAFLDRPLRGLKQIVLHLGNGCSASAIAGTRPLDTSMGLTPLEGLVMGTRSGDIDPSIVSYLCHTAGMGVDDVESMLNHRSGVVGLSGVRDFRRLRELIESGDGAAQLAYSVFTHRLRKYIGAYLAVLGHTDVISFTAGIGENDAAVRRDAVSGMEELGIVLDERRNLAGGKGARQISADDSPITVLVVPTNEELAIARDCVRVLGG

SEQ ID NO: 5336 - protein, 361 aa, Mycobacterium paratuberculosis
MRAARDRPLAPGAGVLVIATLYGGNDGINTLIPYADNAYHDARPELAYAPQDVLHLDQQLGLNPALKGMAGLWNQRKLAVVRGAGYPKHDHSHFRSMDIWQTASPDEPVSTGWIGRWLDATGDDPLRAVNIGAVLPPLAVGAKCTAAALSPGGGAGKAGQFDAVTTALGDDDPDDTPAMAAVCKAYRAARTADATFASVKPPAKQNNSLAAQLDVVAQAVKARVPARVYTVQLGGFDTHAGERGTQQRLLQTFDEAVTGFVAQMAGRNVVLMAYSEFGRRVRANASQGTDHGTAGPVLIAGAPVNGGFYGEQPSLTDLDNGDLKYTTDFRDIYHELLARTVGTDPAPSVGAGRRDLGFLSA

SEQ ID NO: 5337 - protein, 460 aa, Mycobacterium paratuberculosis
VEPQENRKNPQRIFSCTPHSYSMAGQSTLWVGTARMLRRAGFGVTGPEVDAAVARGWPGHLDAMLAADPDADPGALATPMPALPAPQPPGKRATPAARKQYNQQLTEQQGVLSDWWIRRMVVVRQPFHEKLTLLWHNHFATSAQKVRVAAQMAAQNQKLRTLSLGDFRTLAYAMLTDAAMLRWLDGQTSTAKAPNENLAREFMELFALGHGNGYTESDVRNGARALTGWVIGAGGATSVLPKRHDATAKTLFGRSANFDAAGFCDAVLAQPKSAGYVAGRLWQQLAGDDPPSPPALDRLVAAYGPGRDLRALTRAILTDPEFTGARASMVNTPIEWLIGVIRSLRVPVDDPKRLKMIDATLRTLGQRPFYPPSVGGWPSGQVWLSTASAGARLRAATELAHAGDLSGIENTPPTDRIDAVGYLIGVGAWSDRTARALQPLVGQPPRLVAAAVNTPEYLTS

SEQ ID NO: 5338 - protein, 165 aa, Mycobacterium paratuberculosis
LRASRRRRLSRPAKNEGRQRILRILRRAWMPLLLVVVISLGAYAVVRIRDTFGTHGGVTSGEGAGDNTKPFHPKHITYEITGAPAGTVNANYLDENGQPHLVESAPLPWSFTIVTTLPSMSANIVAQASEQVHALRCRVIVDDQVRDDRNTNDYQPFIYCLVKSV

SEQ ID NO: 5339 - protein, 955 aa, Mycobacterium paratuberculosis
MSNPHAQSRLPVIPRLIRVLSLPITLGWVFVAVALGVLSPSLDDVASQHSVPMTPRDAPAFKSMMHIGDKFNEFHTDSTAMVVLEGKDKLGDSAHEFYDRIVRKLRDDHQHVQNIQDFWSDPLTAAGSQSPDGKSAYVQVFLNGAQGTTPSYESVAAVRKIVDSTPAPPGVKAYVAGNTVLNADTSIVGHKSMATMALVSIVVIFVMLLVVYRSIVTTVLSLVIIGIELFAAQGITATAGNLNIIGLTPYAVSMITMLSIAAGTDYVIFLLGRYHEARSFGQDREEAFYTAYHGVSHVILGSGLTIAGACLCLTAARLPYFQTMGLPCAIAMVVIVLAALTLAPAILAVGSRFGLFDPKRAIDVRGWRKVGTAVVRWPKPIIVVTAAIAVIGFISLLTYVPNYDDQKFTPKDMPANAAMTAAERHFSQARMNPELLMVEADHDLRDPADMLVVDRIAKSVFHLRGIERVQTITRPLGAPIEHSSIPFQIAMQNSGTLQTAKFMNDTMANMLEQADELDKTIAVMEHMYGVMKELTATTHSMVGRTHEMVDTTNELRDRIADFDDFFRPIRSYFYWEKHCFDIPVCWSMRSLFDALDGIDELSDQISGLTIDLDHMDRLMPQLLADFPKTIDSMKTMRDFMLSTHSTMAGIQAHQQEAAEGSTLMGQYFDEAKNDDSFYLPPEVFKNPDFKRGLKMFVSPDGTAVRFIITHQGDPASVEGIKHVAGVKDAVADAIKGTPLESSKVYLAGTASMYSDMQEGVIIDLLVAGISCLILIFTIMLIITRSVVAALVIVGTVAASLGTACGLSVLMWQDLIGLGVQWIVLPLSIVILLAVGSDYNLLLVSRLKEEIPAGLNTGIIRGMGASGRVVTAAGLVFAFTMASMIVSQLRVIGELGTTIALGLLVDTLIVRSFMTPSIAAALGHWFWWPINTIRMTRRTHHDEEAHTAPIRQPALR

SEQ ID NO: 5340 - protein, 176 aa, Mycobacterium paratuberculosis
LAALAEHGYDATNMNDIAARAGVGKAAIYRRWSSKAALMTDALIYWRPELLNDDAPDTGSLAGDLDAIVKRAKRNDNALISNDLVLRVALEAAHDPELATALNDLILFKGRRVLSAVLAQAADRGEIDPNRDWSLVADVLTAMGLLRAISGQRVDGKFVRRVIDTLILPAVRAAPE

SEQ ID NO: 5341 - protein, 303 aa, Mycobacterium paratuberculosis
VHSRSRGRRRRARVSRMGETPVVGSEELASGRLNRHRLRVAYRPVFPNVYLPAQVEPTLPLRIRAAWLWSGRTAVIAGAAAAAVHGAAWIPDAVPIELIHHNTRAPDGVLIRRDGLCPGETQICDGLAVTTPERTAFDIGRRGAVRSAVVRLDSLARATGFKADDVLRVAGAHPRSPGLRRLEAALGLVDPGAQSPRESYLRLLLIDAGLPRPQTQVPVPGADGMPVAYLDMGWPEWMVAVEYDGDHHRTDRRQYVKDIRRLEMLEQLGWVIVRVVAEDRPADIVRRVRAALAKSGVAPRLSV

SEQ ID NO: 5342 - protein, 763 aa, Mycobacterium paratuberculosis
MAEPDNKSEQPEPGAEQMGPGTQPAEVGDDAQAGAATGRLQATQALFRPDFDDDDDDFPHISLGALDTDSADRMTVATQALPPVRQLGGGLVEIPRGRDIDPREALMTNPVVPESKRFCWNCGKPVGRSTKKSKGTSEGWCPHCGSAYSFLPQLNPGDIVANQYEVKGCIAHGGLGWVYLAVDHNVNDRPVVLKGLVHSGDAEAQAIAMAERQFLAEVVHPQIVQIFNFVEHVDRHGNPVGYIVMEYVGGQPLRHGKGEKLPVSEAIAYVLEILPALGYLHSIGLVYNDLKPENIMLTEEQLKLIDLGAVSRINSFGYLYGTPGFQAPEIVRTGPTVATDIYTVGRTLAALTLNLPTRNGRYVDGIPDNDPVLGTYDSFRRLLRRATDPDPRRRFSSTEEMSAQLMGVLREVVAHDTGVPRPGLSTIFSPSRSTFGVDLLVAHTDVYLDGQVHSEKLTAREIVTALQVPLVDPADVAAPVLQATVLSQPVQTLDSLRAARHGTLDADGVELSESIELPLMEVRALLDLGDVAKATRKLDDLAERVGWQWRLVWYKAVAELLTGDYDSATTHFTEVLDTFPGELAPKLALAATAELAGDVDEHRFYETVWKTNDGVISAAFGLARTLSAEGDRAAAVRTLDEVPATSRHFTTARLTSAVTLLSGRSKSEITEEEIRDAARRVEALPPTEPRVLQIRALVLGCAMDWLEDNKASTNHILGFPFTEHGLRLGVEAALRNLARVAPTQRHRYALVDMANKVRPTSTF

SEQ ID NO: 5343 - protein, 309 aa, Mycobacterium paratuberculosis
VLVAAGCGHTESLRVASVPTLPPPTPVGMEQLPPQPPLPPDGPDQNCDLTASLRPFPTKAEADAAVADIRARGRLIVGLDIGSNLFSFRDPITGEITGFDVDIAGEIARDIFGAPSHVEYRILSSDERVTALQRGEVDVVVKTMTITCDRRKQVNFSTVYLDANQRILAPRDSPITKVSDLSGKRVCVAKGTTSLHRIRQIDPPPIVVSVVNWADCLVAMQQREIDAVSTDDSILAGLVEEDPYLHIVGPNMATQPYGIGINLNNTGLVRFVNGTLERIRRDGTWNTLYRKWLTVLGPAPAPPTPRYLD

SEQ ID NO: 5344 - protein, 439 aa, Mycobacterium paratuberculosis
VTVELAHPSTEPQGSRSPAEPAHPRWWFISTTPGRILTIGIVLAALGGLSAFATSTTINHRQQVLTTVLNHTEPLSFAAGRLYTTLSVADAAAATAFIAEAEPPPVRQRYEQAITDAAVAVTRASSGLTDEPMVQLLGRINAELAVYTGLIETARTNNRQGNPVGSSYLSEASGLMQSTILPDAARLYQATSKRVDEETTASTQIPAPVIMVVGATVVFGAFAHRWLARRTRRRINPGLVVGALAILVMVVWVGTALTISTTASRSAKDTAAESLKTVTNVAITAQQARADETLSLIRRGDEEKRKQSFYQRLDSMHRQLDEYMSRSDAVDKPDLEGADQLLLRWRQANDRITSYISVGNYRAATQVALGSSEEDSTPAFDKLQDELMKAMDQGRIHLRNDVINARSGLSGAQVGGVVLSLGAAIAVALGLWPRLKEYR

SEQ ID NO: 5345 - protein, 213 aa, Mycobacterium paratuberculosis
VHGDGDGWVISERGAHYWGRYGAAGLLLRAPQPDGTPAVLLQHRAVWSHQGGTWGLPGGARDSHETPEETAVREANEEAGLLVDRLAVRASVVTAEVAGVGGTRWSYTTVIADADELLHTVPNRESAEMRWVAEDEVADLPLHPGFAASWHRLRTEPARLPLSHGDERRQYLPRTIELEDGVFVWCMPGDPADTDEASAQLCRRISALLPAPS

SEQ ID NO: 5346 - protein, 223 aa, Mycobacterium paratuberculosis
VHQRLATLAAARLYLCTDARRERGDLAEFADAALAGGVDVIQLRDKGSPGEQRFGPLEARDELAACEILADAARRHGALFAVNDRADIARAAGADVLHLGQGDLPLEVARAFVGPDVLLGLSSHDRDQMAAAAAGPADYFCVGPCWPTPTKPGRAAPGLALVRAAAELHTGKPWFAIGGIDAQRLPEVLDAGARRVVVVRAITAADDPAAAARRLSSALAAAR

SEQ ID NO: 5347 - protein, 359 aa, Mycobacterium paratuberculosis
VGAPALTVTPDPDHAGEGRPRMPSDCGSLAVVGGGVIGLAVARRAAQAGWSVRVHRSGERGASWVAGGMLAPHSEGWPGEERLLRLGLESLRLWREGGFLDGLPGRLVTARESLVVAVDRADVADLRTVADWLSAQGHPVVWESAARDVEPLLAQGIRHGFTAPTELAVDNRAVLEALDAACERLGVRWAPPLHDLAEADADAVVIANGIDAQALWPGLPVRPVKGEVLRLRWRKGCMPVPQRVIRARMHGRQVYLVPRADGVVVGATQYEHGRDTAPVVSGVRDLLDDACAVLPALGEYELAECGAGLRPMTPDNLPLVGRLDARTLVAAGHGRSGFLLAPWTAEQIVSELAPVGAHR

SEQ ID NO: 5348 - protein, 65 aa, Mycobacterium paratuberculosis
MIVVVNEQKVDVDAHTTVAALLDELGFGGRGVAVAVDDAVLPRSRWTTELSEGARLEVVTAVQGG

SEQ ID NO: 5349 - protein, 252 aa, Mycobacterium paratuberculosis
VVDSKLTIADRSFNSRLIMGTGGAGNLAVLEEALIASGTELTTVAIRRVDAEGGTGLLDLLNRLGITPLPNTAGCRGAAEAVLTAQLAREALNTNWIKLEVIADERTLLPDAVELVRAAEQLVDDGFVVLPYTNDDPVLARRLEDAGCAAVMPLGSPIGTGLGITNPHNIEMIVAGAGVPVVLDAGIGTASDAALAMELGCDAVLLATAVTRAGDPAAMAAAMSAAVTAGYLARRAGRIPKRFWAQASSPPR

SEQ ID NO: 5350 - protein, 245 aa, Mycobacterium paratuberculosis
MAAGPGIRPRAAGAPRWSGRSARNYAHLVAARCGYDLVDVTFSGATTAHVLTERQHGAAPQIAALDGSESLVTVTIGGNDVGYIPLLTVAALPRPLRRLPLLGDRIAELLDAEARNGALEAVFESLCAVGTAVRQRCAEARIFFVDYLTMLPPAGVPAAPLSPADADLGRHVAATLERMTADAAAATGCDLIPAAAASREHHAWSADPWTTLPARYGLPLPGRPAPLHPNAAGMRAVAELIAARL

SEQ ID NO: 5351 - protein, 173 aa, Mycobacterium paratuberculosis
MSYRNTALRLVSAAAFTGSVALAGSAPALAEPNTGSASDMNTLAAALSKGYGLNNCKPQELTESGELAELLCGQSPDPSGPGSGVYALFSNGTNLASAFSSTIKDVSLANCGDAGQSPGTWKQNGQTGGQIACGTYKNYATLTWTTDAKNVLGHLTAANSDVNALYQWWRTNG

SEQ ID NO: 5352 - protein, 177 aa, Mycobacterium paratuberculosis
LMSEFSNALRAATAAVFTGGFVFAGSAAAAADPAGTPNPSDINTLAASLSKGYGLNICTAGNIDRGRQLAVLTCGQSPDPKGPAQAKYVLFTNAENLATAFRATIKEDVLTPCGDAHESPSSWRKDGSSASAGQAACGTFRNAAEIIWTIDAKNILSYLRASNTDVAALYHWWRANG

SEQ ID NO: 5353 - protein, 110 aa, Mycobacterium paratuberculosis
MTQPPPPPPPPGYPPQQPAAQAPNNYLVWSILVTLFCCLPFGIVAIVKSSQVNGLWAQGRYAEAQASADSAKKWVIWSAAIGVVVGIIYGILMAVGALNTNTNAALAAMF

SEQ ID NO: 5354 - protein, 141 aa, Mycobacterium paratuberculosis
MVIRRGAVQQNLTAPVVVAASATVLCAAVWAGDPTTPGGPLPVCPTKALLGVDCPGCGSLRMVYALMHGNLLGAARFNALGLAAVVLLMWAYFAWTYGHLVGRRIRSWQHHRWAAAVTLSLVLAWFVVRNIPVAPFTALHV

SEQ ID NO: 5355 - protein, 498 aa, Mycobacterium paratuberculosis
MVNKFTTFPALLAVVALTALATGCGHRSSGAGQTTGDPAAAEFASGLRNKVTTDAMMTHLTKLQDIANANNGTRAVGTPGYEASVDYVVKTLRDSGFNVQTPEFSARVFHAEKPDLTVGGRPVEAHALDFSLGTGPDGVSGPLVAAPPNNPGCAVTDYGSLPVQGAVILLDRGTCPFAQKEDVAAQRGAVALIIADNVDEQQMGGTLGPSTEVKIPVLSVTKSVGVQLRGQPGPTTIKLTASAQSFKARNVIAQTKTGSEHDVVMAGAHLDSVPEGPGINDNGSGVAAVLESAVRLGSSPPVHNAVRFGFWGAEELGLIGSRNYVESLDLTALKNIALYLNFDMLASPNPGYFTYGGDQSLPMDARGQPVVPEGSAGIERTLVAYLKSAGKTAQDTSFDGRSDYDGFTLAGIPAGGLFSGAEGKMSADQAKLWGGTADQPFDPNYHQKTDTLDHIDRTALGINGGGVAYAIGLYAQDLGGHNGVPAMADRTRHVLAKS

SEQ ID NO: 5356 - protein, 477 aa, Mycobacterium paratuberculosis
VLLAGCSSAGPGLPTAAPDLGHGLAKKVTADAMMAHLRALQNIANTNGGNRADGTPGFQASVDYVAKALRDKGFDVQTPQFDRLYPVSPGKPTLTVAGRGYPVDQASMLVQTPPGGLTGPAVRPAQPSGCAASDYPGALPKGAIAVVDDTRCSVVDKQNSAVARGASALIVVSAPDGHGAPPTLFTPGYYKQLSVPVAVVNPSGAAALAGAGGPVRLILDAVNVKVTSRNVVAQTKTGSAHEVVMVGAHLDGSRAGPGINDNGSGVAAVLETALQLGPLAPVSNAVRFVFWGAGEDGLGGVMDYLFGLDRDQLNDIALYLNFTMLGSPNAGFFTDDGDQSGPPAPGISAADVPEGSAGIERTLAGYLNLAGKRAADMPLNTRADYHPFMVAGVPIGGMTTGASQPKTTVQSRLWGGQAGVPFDPNFQSPRDTADNINRDALAVMGSGVGFAVGSYAQSIGGVNGVPPHDKRHRTRVP

SEQ ID NO: 5357 - protein, 481 aa, Mycobacterium paratuberculosis
MHSHALRSAFVWAAAVLLVAGCSTFVEGRALSMLNDPFLVGGLPATNGPSGIRSNAPAPTGKVLNTDNGSIDSLSLLSINDIEDYWRSVYGQSLKGKFVPISKIVSYNSTDPSSPIVCHNDTYQLVNAFYTSRCNLIAWDRGVFMPVAQKYFGDMSVTGVLAHEFGHALQQMAALVTKRDATIVREQQADCFAGVYLFWVADGKSPRFTLSTADGLDHVLAGIITTRDPVMDSETANDDAHGSALDRISAFQMGFLNGASACASINRREIEQRRGDLPNALRVDTSGAPETGEVPINQDTLSTLMELLGKIFAPANPPALSYQPAACADAKPSPPASYCPATNTIAVDLPKLAALGRVADENEHSLPQGDDTALSVVMSRYALAVQHERGLAMQSPWTALRTACLTGVVHRRMAEPIELPSHNQLLLTAGDLDEAVAGLLTNHLVASDADGTSVPAGFTRIAAFRGGVTGNADACYSRYPG

SEQ ID NO: 5358 - protein, 291 aa, Mycobacterium paratuberculosis
MELGLHFIDFLPGDPARLGPTLTEAARAAEQGGATLLTLADHFFQMEQLGPAENPFLEGYTSLGFLAAQTSTIELALLVTGVTYRYPGVLAKTVTTLDVLSQGRSMLGLGAAWYEREHTALGIPYPALSTRFEMLEETLQICRQMWSDDDGAYQGKHYRLAETICAPQPIRRPPILIGGDGEKKTLRLVAQYADVWNSMSNDLAELEHKIEVLHRHCDAVGRDPRDIRKTCGGLATLDPFENLDEYLRTAERFGRLGIDMINVGPLPGNPDPVGYIRRLGDEVIPRLAEIG

SEQ ID NO: 5359 - protein, 111 aa, Mycobacterium paratuberculosis
LTPSQTAVLTRLWKEGPSSASALAAAERVRPQSMATILAALGQRRLIERSPDPNDKRRQVVSLTAAGRKRAESDRRAREEWLARAIQERYTEAERRVIVDALSLLERLTEQ

SEQ ID NO: 5360 - protein, 207 aa, Mycobacterium paratuberculosis
MNLDRIAGIAHRPDGTPEGVVVLTHGAGGNRDSPLLQQVCDEWAQRGWLAVRYNLPFRRRRPTGPPSGSGAADRAGIVEAITLCRGLADGPLIAGGHSYGGRQTSMVVAAGDAAVDVLTLFSYPVHPPGKPERARTEHLPAITVPTVFTHGTSDPFGTPEELNAAAALVGGTTAVVEIASARHDLRSKTLNVAALAVDAALQLLGRN

SEQ ID NO: 5361 - protein, 282 aa, Mycobacterium paratuberculosis
VTGPPPTLPLAPPGTTPRRVLSIAGSDSGGGAGIQADLRTMAMLGVHACVAVTAVTVQNTLGVNSFHEVPADVVAGQIEAVAGDIGIQAAKTGMLASSPIIAEVAATWRRLELSVPLVVDPVCASMHGDPLLAADALDTLRGQLFPLATLVTPNLDEVRLLVDIDVTDAASQRAAAKALHALGPQWVLVKGGHLRSSQRSCDLLYDGDSCYEFDAHRLATGNDHGGGDTLASAVACALAHGFTVPDAVAFGKRWVTECLRASYPLGHGHGPVSALFRLSGDG

SEQ ID NO: 5362 - protein, 540 aa, Mycobacterium paratuberculosis
MTAIVEPSVTTGPIAGSSKVYRELDGVPGARVPFRRVHLSTGDHFDLYDTSGPYTDPDATIDLTAGLPARPGRVRDRGTQLQRARAGEITAEMAFIAAREGMPAELVRDEVARGRAVIPANHNHPEIEPMIIGKAFATKVNANIGNSAVTSSIAEEVDKMVWATRWGADTIMDLSTGKNIHETREWILRNSPVPVGTVPIYQALEKVKGDPTLLTWEIYRDTVIEQCEQGVDYMTVHAGVLLRYVPLTAKRVTGIVSRGGSIMAAWCLAHHRESFLYTNFDELCEIFARYDVTFSLGDGLRPGSIADANDAAQFAELRTLGELTKIAKSHGVQVMIEGPGHVPMHKIVENVRLEEEWCEEAPFYTLGPLATDIAPAYDHITSAIGAAIIAQAGTAMLCYVTPKEHLGLPDRKDVKDGVIAYKIAAHAGDLAKGHPHAQQRDNALSQARFEFRWNDQFALSLDPDTAREYHDETLPAEPAKTAHFCSMCGPKFCSMRITQDVRDYAAKHGLDSEEAIEAAMADKSREFAEHGNRVYLPLAQ

SEQ ID NO: 5363 - protein, 92 aa, Mycobacterium paratuberculosis
MMAEKKARRGTSQREAVEKIREGETFVVNLPGLGQVEIPRPEQLAYFGGLAALAALELIDWPVAVVIAAGHLLASNHHNKILEELGEAMEEV

SEQ ID NO: 5364 - protein, 149 aa, Mycobacterium paratuberculosis
MSVIGGAVRGVSQAVNRAASATTAAAGAVGGAAVNGVIGGVTGAAEGVKRGMNSGSHSTPAAALAFGALGVAGLVEWPVLLAVGGGALLLQRLNRKERQPEPRAVKANLKSVPAESAPARKAPAKTAAKSTAKKAPGRRAGAGDLRSTN

SEQ ID NO: 5365 - protein, 272 aa, Mycobacterium paratuberculosis
VRLATWNVNSIRSRLPRVLDWLARTEVDVLAMQETKCADGQFPTLPFFELGYEVAHVGFNQWNGVAIASRVGLDDVRVGFEGQPSWSGKPEVAAAAEARALAATCAGVRIWSLYVPNGRAVGDPHYAYKLDWLAALRDSAAAWLREDPAAQIALAGDWNIAPQDDDVWSMEFFAGATHVSEPERRAFNAILDAQFADLVRPFAPGPGVYTYWDYTALRFPKRQGMRIDFILGSPALARRVTHAQIDREERKGKGASDHAPVLVDVSRDEPPS

SEQ ID NO: 5366 - protein, 278 aa, Mycobacterium paratuberculosis
LDARRGTGPVRSLMFSWPDPGTRVTVRYRRPPGSVPPLTDAVGRLLTVDPTVRVQTKTGAVVEFAPADVVALRVLTDTPIRTSQIRALEHAAAWPAAEQTWLHGWLLRAGPPPGRPAGPSTDSAVPLDLSAHAEAIPEIAGWYQRRGLTPRLAVPDRMLTPPPGLTCERTEQVVVQDLSRPSGDEPGVRVDASVAQAAVSAAPDGTRWVGLWVPPGGHDAEARAGCEALLAWGAGRGATRAYLAVPDDDTAALELAGALGFRLHHRRRYLTVPAGPVG

SEQ ID NO: 5367 - protein, 197 aa, Mycobacterium paratuberculosis
MAVVPIRIVGDPVLHTPTQPVPVGDDGSLPADLGKLIADMYDTMDAAHGVGLAANQIGVGLRVFVYDCADDRGLTERRRGVVVNPVLETSEIPETMPDPDTDDEGCLSVPGESFPTGRASWARVTGLDADGNPVSIEGHGLFARMLQHETGHLDGFLYLDRLIGRYARSAKRAVKSHNWGVPGLSWMPGEGPDPFGH

SEQ ID NO: 5368 - protein, 102 aa, Mycobacterium paratuberculosis
MDSAMARANRSGDDAEIADGLTRREHDILAFERQWWKFAGVKEDAIKELFSMSATRYYQVLNALVDRPEALAADPMLVKRLRRLRASRQKARAARRLGFEVT

SEQ ID NO: 5369 - protein, 158 aa, Mycobacterium paratuberculosis
MKERVPDSTGLPLRAVVMVLLFLGVIFLLLGWQALGSSGNSEDDSASPVSSSTATSSASASPTNKPAANQAEVQVYNISSKEGVAARTKDQLTSAGFKVTKVDNLAVPDVSATTVYYTDADDEHATADAVGKNLGAPVEPRIPALSGQPPGVIVLVAG

SEQ ID NO: 5370 - protein, 227 aa, Mycobacterium paratuberculosis
MPKLLPPVVLAGCVVALGACSSPQHASSLPGTTPAVWTGSPSPSGAGAAEAAPAAAPSITTHLKAPDGTQVATAKFEFSNGYATVTIETTANGVLTPGFHGVHIHKVGKCEPSSVAPTGGAPGDFLSAGGHFQAPGHTGEPASGDLTSLQVRKDGSGTLVTTTDAFTMEDLLGGRKTAIIIHAGADNFANIPAERYNQTNGTPGPDEMTMSTGDAGKRVACGVIGAG

SEQ ID NO: 5371 - protein, 388 aa, Mycobacterium paratuberculosis
VTPASGWRAVSSVPARRGDAHIDFARSPRPTIGVEWEFALVDAQTRDLSNEATAVIAEIGENPRVHKELLRNTVEVVSGICRTVPEAMEDLRQTLGPARRIVRDRGMELFCAGAHPFAQWTTQKLTDAPRYAELIKRTQWWGRQMLIWGVHVHVGISSPNKVMPIMTSLLNYYPHLLALSASSPWWTGVDTGYASNRAMMFQQLPTAGLPFQFQTWAEFEGFVYDQKKTGIIDHVDEVRWDIRPSPHLGTLEMRICDGVSNLHELAALVALTHCLVVDLDRRLEADESLPTMPPWHHQENKWRAARYGLDAVIILDADSNERLVTEDLDDVLNRLEPVARKLQCADELAAVADIPRHGASYQRQRRVAEEHDGDLRAVVDALVAELEI

SEQ ID NO: 5372 - protein, 213 aa, Mycobacterium paratuberculosis
MTEPVALPMFPLESALLPDQDLPLRIFEPRYGALVRHCLDTGEQFGVVLIARGREVGGGDARCDVGVLSRIVDCVDQGAGRYLLNCRTGQRIRVSEWLPDDPYPRATVMPWPDEPGAAVTPEQLRGVEDRAVALFERIAQARGITLPGRDVLLGRHDPERPPGQRLYELASRIPIGTADRYTVLCAPSAAERLAALREAVDAVTEVVEFQLSE

SEQ ID NO: 5373 - protein, 340 aa, Mycobacterium paratuberculosis
MKVQLQVDGSPVRAAASAAEIAATGADGLFTFEGQHDVFFPLLIAAEATGCELMTNVAIAPPRSPMHLAYAAYDLQLYSGGRFRLGLGSQIKVHVEKRYGSRWEPPAARMAEAISAIKAIFAAWEGRARLDFRGEFYTHTIMAPTFDPGPNPYGAPPVLLGALGPVMTRTAAEVADGLLVMPFNSARHFAERTLPAIGEGLRRSGRTLTEFPIIAQAMVAVGRDEADLATAIDAVASLIAFYGSTPAYLPVLQVEGWDGIQPELNALSKQGRFAQMRGLITDEMVARIGIVGTPEQCAEQIAARFGEHADEVCCYFPGYTPRPADVADLIGALHRVPALP

SEQ ID NO: 5374 - protein, 272 aa, Mycobacterium paratuberculosis
VTTDLTAEIDSGVAVLTLNRPDRLNAYTAEMGELLGRAYRECDEDDDVRVIVLTGAGRAFCAGADFSGGASPFDAPAGDGAFTASPITPAAFELRKPVIAAVNGHAVGIGLTIALQADIRIVAEDAKYGVVQVRRGVLPDCMAHWTLPQLTNLGVAADLLLTGRMFGGAEATALGIANRALPADRVLDEAMALARDIAVNVAPMSAALCKRLLWDSAINRYPPRQVAALETLLHERVMGGGDAAEGVAAFLEHRAPRFTARLSSEWEPLPEP

SEQ ID NO: 5375 - protein, 274 aa, Mycobacterium paratuberculosis
MLPRRRHDLVHSFYMERLPYIDEHAITIEANRDDTWAALLRVLCRDPHDPSTVPLGFALDEARPPVRFALKGRHPFAVYRWVFELDTLDGPARTRLRAATWAAFPGVHGKAYRALVIGTGGHRIVVRRTLNRVARAAARADYTDVFEVPLPQGDSRSAEETFRDAVGRPGAGGDAVRWVHRHVLRLGGWTIVRSARDEVVLAARGPLMDARLTLRREDGRRAVLTTRLHYRHKLAARAVWALVGPLHRIVAPRLMRRAAVMAPAAAPTPTTAAR

SEQ ID NO: 5376 - protein, 198 aa, Mycobacterium paratuberculosis
MAPPRKHETDVILDAARALVLDGGPRAASVAAIAKASGAPAGTLYHRFGNRDGILTAAWLRALERFQARALAADGDTPEDTAVAMAVAAVGFARALPDDARLLLTIRPGDLLDGEPDAAFRQTLAAMNAPLTQRLAQLARHLYGNARPRSVDAVARAVADLPYAVVRRHAHDDPMPSWLETDVAASARAVLRSFGERP

SEQ ID NO: 5377 - protein, 720 aa, Mycobacterium paratuberculosis
VTGSGSARQLTLTARLNTSAVDSRRGVVRLHPSAVAALGIREWDAVSLIGSRTTAAVAGLAGPEIPSGTVLLDDVTLSNAGLRDGTAVVVSPVTVYGARSVTLSGSPLTTRSVSPVTLRQALLGKVLTVGDAVSLLPRDLGPGTSTSEATRALAAAVGISWTSELLTVTGVDPDGPVSVQPNSLVGWGAGAAPAAASRASVEEARPQTVVEELKGCQPQAAKLVEWLKLALDEPHLLKTLGAATFLGVLVTGPAGVGKVTLVRAVCGDRRLVTLDGPEVGALGADDRLKAVASAVQTVRDGGGVLLITDVDALLPATAEPVASLILAELRGAVASEGVALIATSARPDQLDARLRAPDLCDRELSLPLPDAATRKALLESLLRNVPTDGLDLDEIASRTPGFVVADLAALIREAALRAASRASSDGRPPALHQEDLTGALSVIRPLSRSAAEEVSVGDITLDDVGDMAQARQALTEAVLWPLQHPDTFARLGVQPPRGVLLYGPPGCGKTFVVRALASTGQLSVHAVKGSELMDKWVGSSEKAVRELFRRARDSAPALIFLDEVDALAPRRGQSFDSGVTDRVVAALLTELDGVDPLRDVVVLGATNRPDLIDPALLRPGRLERLVFVEPPDAAARREILRTAGKSIPLSADVDLDELAAGLDGYSAADCVALLREAALTAMRRSIDATDVTAADLAAARENVRPSLDPAQVASLRAFAE

SEQ ID NO: 5378 - protein, 287 aa, Mycobacterium paratuberculosis
MISKPRGRRAVNLQILPSAMTVLSVCAGLTSIRFALEHQPKAAMALIAAAAILDGLDGRVARILDAQSRMGEEIDSLADAVNFGVTPAIVLYVTLLTTSPAGWVAILLYAVCVVLRLARFNALLDDGSQPAYTHEFFVGMPAPAGAVSMIGLIGLKLQFGDGWWTSPLFLCIWITGTSILMVSKIPMRKMHAVAVPPSWAAPLLAVLAICAAAAVLAPYVLIWVIIVAYLCHVPFAVRNQRWLAAHPEAWDEAPKQRRAARRAIRRAQPNRRSVTRLGLRKPGRRVP

SEQ ID NO: 5379 - protein, 240 aa, Mycobacterium paratuberculosis
VARRPRTIGPSAADPGFSPQHALELVRSAIPPVHPAGRPFVGAGLALALAGRRHRWLRRAGLLAAGACAGFFRHPPRVPPTRPGAIVAPADGEICVIDVATPPAELSMGDVALPRVSIFLSLLDAHVQRAPVSGEVIDVQHRPGRFGSADLAAASTENERTSLRIRTPGGAEVVAVQVAGLLARRIICDAHVGDKLSIGDTYGLIRFGSRLDTYLPAGAQPLVTVGQRAIAGETVLAELP

SEQ ID NO: 5380 - protein, 412 aa, Mycobacterium paratuberculosis
VPRGHLTEPVTDSSPPAKGTFTVDMLSRAKRGVTAVFVAHGLLFASWAAHIPQVKAGLGLDDAALGTALFGAPLGSVLATLAGHWALPRWGSHRLIPVTVAGYAAAGTTVGLARSGPALFAALALWGMFQGTLDVAMNTQAGTVERRAGAPMMARFHGMWSLGTLAGALIGAACVGAGIGLTAQLTVLGAVVLLVVVMLTRRLLPDAADSVAAPPEPAAGRRMTPAVAILAAVSFASFLCEGAATDWSATYLRDVVGAGPSVAAASYAAYTLTMVVTRFGAARLHARLPSRRLLPALAVLAVAGMSVALATADAAAGVLGFAALGVGVALLVPTAFSAAYGARGAGSAIAIVAATGWLGYLLGPPLIGHLSEWVGLSGALVTIPVMMTVVAVAIRYTPAFDTADEFHRAPAG

SEQ ID NO: 5381 - protein, 401 aa, Mycobacterium paratuberculosis
MRSVAEHQRVVAGLIRARPPVAVPLAQAQGLVLADDVVAGLALPVFDNSAMDGYAVRAEDTAGATPERPVVLPVAEDIPAGRTDELTLQPGTAHRIMTGAPVPAGATAVVPVEDTDGGVDVVSIRASREPGKHIRRAGEDVSPGTTVLRRGQVVTPAVLGLAAALGIAELSVIPRQRVLVISTGSELVAPGAALRPGQIYESNSIMLAGAVRDAGAELVAVATAEDEVAQFSSIIDRYAAGTDLIITSGGVSAGAYEVVKDAFGREGDQGVEFVKVAMQPGMPQGVGRVAGATIVTLPGNPVSALVSFEVFIRPALRAAMGLPDPERPHRSAVLAESLTSPRGKRQFRRAVLDDDAGTVVSYGPPASHHLRWLASANGLLDIPEDVVEVPEGTTLEVWDLR

SEQ ID NO: 5382 - protein, 312 aa, Mycobacterium paratuberculosis
MAPHDKQHRDWSEADVGDQSGRVVVITGANTGIGYETAAVLAHRGAHVVLAVRDLEKGNAALSRIVAASPNADVTLQQLDLASLASVRSAAEALRAAYPRIDLLINNAGVMWTPKQVTEDGFELQFGTNHLGHFALTGLLLDHLLGVRDSRVVTVSSLGHRLRAAIHFDDLHWERRYDRVAAYGQSKLANLLFTYELQRRLAAAPDAKTIAVAAHPGGSNTELARHLPGIFRPVQAVLGPVLFQSPAMGALPTLRAATDPAVQGGQYYGPDGFLEQRGRPKLVESSAQSHDEQLQRRLWAVSEELTGVHFPV

SEQ ID NO: 5383 - protein, 172 aa, Mycobacterium paratuberculosis
MLTGRLDLMSLVVPPYPPARYTKDQPETSAWLKRADEPPDYQTAGVKYHYLANQHDTAGDYGLYRVDIAPAGGGPGPHFHRAMSEAFFVLSGTMKLYDGTEWTDGHQGDFLYVPPGGVHGFRNEADDPASILMLFAPGAPREAYFEGFAALADMTDEERREWFARHDNFWVQ

SEQ ID NO: 5384 - protein, 241 aa, Mycobacterium paratuberculosis
MRSSLPVSIAKVEASEDVRVRRLLDAQDKAAQLFDEIERRGMIRPGVAERQLSDEIHDLAGAMFGVRQHWHRRIVRAGPNTLQPFQERPPDRTIAADDIVFLDLGPVFEEWEADFGRTFLLGDDPHKKAVRDALPRVWQAGRDYFAGHPDVTGAELFDAVVAVARAEGFEWGSHIAGHLIGEFAHKKIAGPGIEWYIMPGSDKPMRRTDPRGRTCHWILEIHLVDRRRGFGGFYEQLLDLP

SEQ ID NO: 5385 - protein, 541 aa, Mycobacterium paratuberculosis
MAKTIAYDEEARRGLERGLNALADAVKVTLGPKGRNVVLEKKWGAPTITNDGVSIAKEIELEDPYEKIGAELVKEVAKKTDDVAGDGTTTATVLAQALVREGLRNVAAGANPLGLKRGIEKAVEKVTETLLKSAKEVETKDQIAATAAISAGDQSIGDLIAEAMDKVGNEGVITVEESNTFGLQLELTEGMRFDKGYISGYFVTDAERQEAVLEDPFILLVSSKVSTVKDLLPLLEKVIQAGKPLLIIAEDVEGEALSTLVVNKIRGTFKSVAVKAPGFGDRRKAMLQDMAILTGGQVISEEVGLSLESADISLLGKARKVVVTKDETTIVEGAGDSDAIAGRVAQIRTEIENSDSDYDREKLQERLAKLAGGVAVIKAGAATEVELKERKHRIEDAVRNAKAAVEEGIVAGGGVALLHAIPALDELKLEGEEATGANIVRVALEAPLKQIAFNGGLEPGVVAEKVRNSPAGTGLNAATGEYEDLLKAGIADPVKVTRSALQNAASIAGLFLTTEAVVADKPEKAAAPAGDPTGGMGGMDF

SEQ ID NO: 5386 - protein, 266 aa, Mycobacterium paratuberculosis
LRTRYRKVFRDVYIAKDAELTPAGKARAAWLSTGATLAGLSAAAIHGTKWLDAAAPAEIVRADRHGQRGILVRSYTLADDEADSVSGMRVTTAARTAFDIGCGLPAAKALPILDALLNATGIKPADVVAVADRHRGARGIRRLRASLELADGGAESPQETRLRVLLVRAGLPKPQTQIELRELRVRVDMGWREWKVAVEYDGIQHWDDPYQRAWDIERIALLEAAGWAVIRVSAAMLSRPQVIVERVTAKLAERGAYGRPRASSRA

SEQ ID NO: 5387 - protein, 130 aa, Mycobacterium paratuberculosis
MRSKKKVDLQALADALADYPYAYLITVDDDYRAHTVTVEPVLRESILDVGLIGGRTQQNLARRRDVTLLWPPTEPGGYSLIVDGTAQVSEAGDAVRLAVAPTRALLHRDADSADAAKGCLHDCVVFSLPA

SEQ ID NO: 5388 - protein, 214 aa, Mycobacterium paratuberculosis
VTNPHFAWLPPEVNSALIYSGPGPGPLLAAAAAWDGLAEELASSAQSFSSVTSDLASGSWQGASSAAMMTVANQYVSWLSAAAAQAEEVSHQASAIATAFEVALAATVQPAVVAANRALVQALAATNWLGQNTPAIADIEAAYEQMWASDVAAMFGYHADASAAVAKLPPWNEVLQNLGFSNASTAVTRPAGSGAVARGYTSRIAGFLAPRAPQ

SEQ ID NO: 5389 - protein, 576 aa, Mycobacterium paratuberculosis
MTYDLIIRNGSIVDGLGGEPYVGDVAVRDGVIAAVGAVNGATANREIDATGRLVTPGFVDLHTHYDGQAVWSERLTPSSAHGVTTVVMGNCGVGFAPCRQSDHDVLVDVMAGVEDIPGVVMTDGLPWTWETFPEYLDTLEAGKRDIDVAAYLPHSPLRVYVMGQRGADREPATAEDLAKMRALAKEAVEVGALGFASSRLTIHKTESGSPIPSYDAAREEIEQIARGVVDGGGGLLQFVPDIPADGYQPVLQTVFDVAEDVGLPLTFTLVVANSGDPTWPDAITMIEKANAAGGDITAQLLPRPIGLIIGLQLSANPFVLYPSYREIAHLPLAERVAQMRKPEVRARILADKPGEGHPILYVAQMWDWIYPLGDNPDYEPDPSTSIAARARARGVDPMEEAYDRLLDDDGRAMLLVATSNLQGNSLDTVGELLHRDDVVLGLGDGGAHYGMICDASYSTYFLTHWARDRKSGRFSVADAVRRLTSVPARVAGLGDRGRIAVGYKADLNVIDHAALRLHKPVISHDLPAGGRRLDQTADGYVATIVSGEIIAENGVPTAARPGKLVRGRRPGPAPLR

SEQ ID NO: 5390 - protein, 121 aa, Mycobacterium paratuberculosis
VIDHVGINCANYAESQRFYDAVLGTLGFSRQLDVGPAIGYGRAGKPTFWISDALAGPNREVHLAFEAADEDAVRAFHRAAVDLGAEVLHPPRLWPEYHPGYFGAFVRDPDGNNVEAVWHGA

SEQ ID NO: 5391 - protein, 171 aa, Mycobacterium paratuberculosis
MRADSDAVTRELLRDAFTRLIEHVDELTDGLTDKVSGYRPTPDANSIAWLIWHSARVQDIQLADIAGVEQVWTRDGWVDRFGLDLPRNDTGYGHSPEDVAKVRAPADLLSGYYHAVHELTCEYIAGVTAGELSRVVDTNWDPPVTASARLVSIIDDCAQHLGQAAYVRGIQ

SEQ ID NO: 5392 - protein, 264 aa, Mycobacterium paratuberculosis
VAVPAGWVQLHVVDADGYAALARRAAADPALQSAMAAELTTRAMALIAEHGGGRYPVDGTQVHDAAAAFTAGPAFPPLFAQANRAAHAWLFDESGAGGGQWAVDVAPMLDDPSIRPLLRRHNVAVPAKLTVPLTVSVPRQGRLSGLTRWGPWLSLGSAALCGVGALLTLAAARRRGKALSGLGVAALLVGAAGWAGLEAAGRYVNDALNHTTGNVRRIAEVMVAHAESGVHQWLDATLLAGAALAGLGVLVAVLGGLAGAASRR

SEQ ID NO: 5393 - protein, 599 aa, Mycobacterium paratuberculosis
LYNARGVICRGPLSPAATRQAGRVQTIALIGFLGGLITGISPCILPVLPVILLSSMDGDRRGVGSAARPYLVIAGLVCSFSVATLIGSALLTALHLPQDAIRWTALVVLTVIGLGLIFPPLQQLIERPFAYLPQRQSRPGADGFGLGLTLGALYVPCAGPVLAAIVVAGGTSSIGPGALVLTATFAAGNALPLLAFALAGRRVAQRVAAFRRRQRAIQVAGGIAMIVLAVALVFNLPAMLQRAVPDYTTAMQNRLGANDIQRSLSPAGPPPTQGGALQLSPDDVTGGGALSDCSDGSAELQRCGPAPALTGITGWLNTPDGKPLDPAVVRGKVILIDFWAYSCINCQRAIPHVIDWYDRYHDSGFLVIGVHTPEYAFERVPGNVASGAADLHIGYPIALDNDYATWNNYQNLYWPAEYLIDATGQVRHTKFGEGDYDGTERLIRELLTAAHPGARLPAPANTADTTPQSRLTPETYLGVGKAGNYGGTGDYRSGTATLSYPATLGEDRFALRGRWTLDDQGATAAGDDCAVRLNYTAKDVYAVVGGTGTLTVTRDGTTTTTPIGGAPTLHRIVADDSAHRDQLDMRVSPGLQVFSFTFG

SEQ ID NO: 5394 - protein, 228 aa, Mycobacterium paratuberculosis
VRYARPVAQLTFQRARTEEKKRQRAEALVEAARSLALETGVASVTLTAVARRAGIHYSAVRRYFTSHKEVLLHLSAEGWVRWSNTVSDKLAQPGAATPSRIAETLADALADDPLFCDLLANLHLHLEHEVDAERVVEVKRISTAATLSLADSIQRALPELGRSGSLDILLAAYSLAATLWQVANPPERLTDAYAEEPEVVPPEWNLDFASALTRLLTATCIGLIPQSA

SEQ ID NO: 5395 - protein, 172 aa, Mycobacterium paratuberculosis
LNKQDSAGREGGETARQRARKKGFLGRFWLVLTIAAVVALSGFVVYRLHGIFGVHPGSFGGGTSGEVLDEFNAKTITLQVWGPPGSTATINYLDENSHPQQALNVPLPWSKVLSSTKPGIPANLVAQGDGSWIACQFVVNKHDGSGDVIKTPNRSDPNQTVNAFVYCLDKSA

SEQ ID NO: 5396 - protein, 962 aa, Mycobacterium paratuberculosis
MSEPVEAAPRVDQPLIPPFLPRMIHRLALPIVLVWLGIVFITNTVAPQLEVVAKTHSVSMSPTDAASFQSMMKVGATFKEFNSDNSAMILLEGDKPLGAEAHRYYDEIVRRVEQDKKHVQHVQDFWSDPLTAAGSQSHDQKAAYVQVYLAGNMGGGLANESALAVRKIVDSVPAPPGIKAYVTGAGPLFADQSHAGEKGVAVVTLITFVVIIVMLLVVYRSIITVAVMLGMVFIELAAARGVVATLGNYGVMGLSTFANNMLVLMAIAAGTDYAIFVVGRYHEARGLGETREQAFYTMFHSTAHVVLGSGLTIAGAMYCLSFCRLPYFQSLGVPCAVGMLVAVLAALTLAPAMLTVASFFKLMDPKRTLQTRGWRRMGTAVVRWPAPVLAVTIAVALVGLLALPGYKTDYDNRHFLPADTPANVGYAAADRHFDQARLNPELLMIETDHDLRNPADFIVLDKVAKAVFHIPGIGRVQTITRPLGTPLDHSTLGFQMGAQAAGRLQTQHYQEEQANNLLKQADELRKTMATLHEQMQVTQDLSNTTHETTRLTKETVQITERLRDDIANFDDFLRPIRSYFYWEKHCYDIPVCWALRSVFNALDGIDQVAENIVNLSANLDKLDRIQPKLVALIPPQIESQQRNLDTIMSNYAITQGLNDQAKAQADNATAQGDAFDKAKNDDTFYLPPEAFKSPDFARGLKNFISPDGRAVRLIISHEGDPASPEGIRHIEPIKQAVHEAIKGTPWEGAKVYLGGTAATYKDMHDGSNIDLLIAGIAAATLIFIIMLVITRSVVAAFVIVGTVLLSLGASFGLSVLLWQYILGLKLHWMVLAMAVILLLAVGSDYNLLLISRFKEEIHAGLKTGTIRAMAGSGSVVTSAGLVFAATMATFMFSPLLVMAQVGTTIALGLLFDTLIVRSFMTPSLATLLGRWFWWPQHVRPRPASTMLRPYGPRRAVRELILA

SEQ ID NO: 5397 - protein, 119 aa, Mycobacterium paratuberculosis
MSRLSRGLRAGAAFVALGVTAAIFPSTAVADSTEDFPIPRRMINTTCDAEQILAATRDTSPVYYQRYMIDFNNHPNVQQATIDKAHWFYALSPQDRRNYSENFYAPPRPIRCGRPGPTT

SEQ ID NO: 5398 - protein, 303 aa, Mycobacterium paratuberculosis
MPSDFETLLYTTAGPVATITLNRPEQLNTIVPPMPDEIEAAVGRAERDPAIKVIVLRGAGRAFSGGYDFGGGFQHWGEAMMTDGRWDPGKDFAMVSARETGPTQKFMAIWRASKPVIAQVHGWCVGGASDYALCADLVIASEDAVIGTPYSRMWGAYLTGMWLYRLSLAKAKWHALTGRPLTGVQAAEIELINEAVPFERLEARVAEVAAELARIPLSQLQAQKLIVNQAYENMGLASTQTLGGILDGLMRNTPDALEFIKIAETRGVRAAVERRDGPFGDYSQAPPELRPDPSHVIVPDRDG

SEQ ID NO: 5399 - protein, 102 aa, Mycobacterium paratuberculosis
VSAQRIELTLLATGLIFILVSAAQARYRFINDRRAGRRFYWATSVIGIVCFAFGTGRLWPNGVLAAAIFAAVVAFSAYLTTPYLKINGRIYASSPENREPDP

SEQ ID NO: 5400 - protein, 679 aa, Mycobacterium paratuberculosis
MTSHARTDAAAEYDPYLWLEDMTGEQALDWVRARNEPTLARFRDAEFERMRVEALEVLDTDARIPYVVRRGEHLYNFWRDADNPRGLWRRTTLDSYRTDAPEWEVLIDVDELGRADGEKWVWAGAAVIHPEYTRALISLSRGGSDACIVREFDMQTKQFIDDGFALAEAKSQLSWEDPDTVLVGTDFGPGTLTESGYPRVVKRWRRGTPLDEAQTVFEGARSDVNVVASVSRIPGFGRTLIGRALDFWNEEVYELRGGQLVRIDTPTDASVSLHRRWLLVELRSDWTLGTRTYAAGSLLAADYEEFLSGARDFRVVFEPDEHTALNHYAWTEDRLLMVTLVDVASRVEIVRPGDWRREPVAGIPAATNTVVVSADDTGDEFFLDSSGFDSPSRLMRGTDDGRLEQLKTAPAFFDAENISVAQYFVDSTDGTPIPYFVVRPTGPAADRPGPTLLYGYGGFESSNTPGYSGVLGRLWLARGGTYVLANIRGGGEYGPGWHTQAIREGRHKVHEDFAAVATDLVDRGITTVAQLGAQGGSNGGLLMGIMLTKYPEKFGALVCSVPLLDMKRYHLLLAGASWVAEYGDPDNPDDWAFISEYSPYQNISATRRYPPVLITTSTRDDRVHPGHARKMAAALEAAGHRVYYYENIEGGHAGAADNEQVAFKSALTYSFLWQTLGRP

SEQ ID NO: 5401 - protein, 507 aa, Mycobacterium paratuberculosis
MTVFARPGSAGALMSYESRYDNFIGGQWVAPARGRYFENPTPVTGQTFCEVARSDEADVDKALDAAHAAAPAWGKTAPAERAAILNKIADRIEENLESLAVAEVWDNGKPIREALAADIPLAADHFRYFAGALRAQEGSLSQIDDDTVAYHFHEPLGVVGQIIPWNFPILMGAWKLAPALAAGNAVVLKPAEQTPVSVLYLMSLIGDLLPPGVVNVVNGFGAEAGKPLASSNRIAKIAFTGETTTGRLIMQYASQNLIPVTLELGGKSPNIFFSDVMAKADDYQDKALEGFTMFALNQGEVCTCPSRSLIQADIYDEFLELAAIRTKAVRQGDPLDSETMLGSQASNDQLEKVLSYIAIGKDEGATIITGGERAELGGDLSGGFYMQPTIFAGNNKMRIFQEEIFGPVVAVTSFTDYDDAISIANDTLYGLGAGVWSRDGNTAYRAGRDIQAGRVWVNCYHAYPAHAAFGGYKQSGIGRENHKMMLDHYQQTKNMLVSYSNKAQSFF

SEQ ID NO: 5402 - protein, 160 aa, Mycobacterium paratuberculosis
MEPRPPSGVVITAAAAEVLARLQRQHGPVMFHQSGGCCAGSSPMCYPVGDFLVGDRDVLLGVLDVGADGVPVWISGPQYAAHYRDKHTQLVIDVVPGRGGGFSLEAPDGVRFLSRGRVFSAAEQAAVAAAPIITGADYQRGERPAARGAVVADAACRTCP

SEQ ID NO: 5403 - protein, 92 aa, Mycobacterium paratuberculosis
VIPLPRPWVLAGAMLIGSAVGLLAGVAFTVAVQAHVRPDLAIAAVVGIPSVIGLALILFSGRRWVTTLGAFVLAVAPGWFGVLVALRVTAGG

SEQ ID NO: 5404 - protein, 189 aa, Mycobacterium paratuberculosis
VADDKDASSPGTEAFVPDFSDDDDAADTGTQSWAPDFDDDAEDDDAEAAEPAAEREPEPEPEPEPEPAGFAGPVPPVAVPGRYFYVKWWKLVLVLLAVWAASAVIGLGLFSWWYHSIDKTPALFAVLVFVMVCVVGGVMLAMVEARPLISALAVAVLSGPFAALAAAAPLYGYYYCARVGHCLVGVVPY

SEQ ID NO: 5405 - protein, 431 aa, Mycobacterium paratuberculosis
VTSHYDVVVLGAGPGGYVAAIRAAQLGLSTAIVEPKYWGGVCLNVGCIPSKALLRNAELAHIFTKEAKTFGINGEATFDYGAAFDRSRKVAEGRVAGVHFLMKKNKITEIHGYGRFTDPHTLAVELNDGGTETVTFDNAIIATGSSTRLVPGTSLSANVVTYEEQILSRELPESIIIAGAGAIGMEFGYVLHNYGVEVTIVEFLPRALPNEDADVSKEIEKQFKKLGVKILTGTKVESISDDGSQVTVVVSKDGNSQELKAAKVLQAIGFAPNVEGYGLEAAGVALTDRKAIGITDYMRTNIEHIYAIGDVTGKLQLAHVAEAQGVVAAETIAGAETLALGDYRMMPRATFCQPNVASFGLTEQQARDEGHDVVVAKFPFTANGKAHGVGDPSGFVKLIADANTVSCWAGTWSATTSPSCCRSSPWRRSGT

SEQ ID NO: 5406 - protein, 93 aa, Mycobacterium paratuberculosis
MLRTLTPQTIAAALGGLATGYVLWLLAISNGDNATVGQWGPLVLVASVVLGGAAAVWGAWQRRRGSRPRAAFAFALPVLPVLLTLAILADVYL

SEQ ID NO: 5407 - protein, 185 aa, Mycobacterium paratuberculosis
VTAPRIPAGRFRQLGPINWVIAKLGARTVGAPEMHLFTTLGQRRLLFWTWLAYGGRLLRGKLPTADTELVILRVAHLRGCEYELQHHRRMARTAGLDPDLQAAIFAWPQRLEPVQARLTVRQQALLAATDEFVNDRTVSEATWRQLAEHLDRRQLIEFCLLASQYDGLAATMSALAIPLDHPEGS

SEQ ID NO: 5408 - protein, 506 aa, Mycobacterium paratuberculosis
MPTTCAEHQSRRGHRGCQLCEPGLHRPGNLGGVSKTFVGSRVRQLRHERGFSQAALAQMLEISPSYLNQIEHDVRPLTVAVLLRITEVFGVDATFFSSQDDTRLVAELREVTMDRDLDIDVDPTEVAEMVSAHPGLARAVVNLHRRYRITTAQLAAATEERFFDGSGTGSITMPHEEVRDYFYQRQNYLHELDTAAEDLTIKMRLHHGDLARELTRRLTEVHGVHINRRIDLGDTVLHRYDPETKTLEISNHLSWGQQVFKMAAELAYLEFGDLIDSLVAQGKFTSEESHKLARLGLANYFAAAAVLPYRQFHDVAENFRYDVERLSSFYSVSYETIAHRLSTLQRPSMRGVPFSFIRVDRAGNMSKRQSATGFHFSSSGGTCPLWNVYETFANPGKILVQIAQMPDGRNYMWVARTVERRAARYGQPGKTFAIGLGCELRHAHRLVYSEGLDVSGGPGTVATPIGAGCRVCERDNCPQRAFPALGRALDLDEHRSTVSPYLVKQS

SEQ ID NO: 5409 - protein, 264 aa, Mycobacterium paratuberculosis
VSLDKQMMPVPDGHPDVFDREWPLRVGDIDRTGRLRLDAAARHIQDIGQDQLREMGFEETHPLWIVRRTMLDLIRPIEFNDMLRLRRWCSGTSNRWCEMRVRIDGRKGGLIESEAFWININRETQMPSRIADDFLAGLHKTTSVDRLRWKPYLKPASRDDAVEIHEFPVRVTDIDLFDHMNNSVYWSVIEDYLASHTELMRTPLRVTIEHEAPVALGDKLEIISHVHPAGSTDQFGPELADRTVTTLTYAVGDEAKAVAAIFAR

SEQ ID NO: 5410 - protein, 430 aa, Mycobacterium paratuberculosis
MPTSVVGTPKSAEEIQKDWDTNPRWKDVTRTYTAEDVVALQGTVVEENTLARRGAEVLWEQLHDLEYINALGALTGNMAVQQVRAGLKAIYLSGWQVAGDANLSGHTYPDQSLYPANSVPTVVRRINNALLRADQIAKVEGDTSVKNWLAPIVADGEAGFGGALNVFELQKAMIAAGVAGSHWEDQLASEKKCGHLGGKVLIPTQQHIRTLTSARLAADVCDVPTVVIARTDAEAATLITSDVDERDQPFITGERTKEGFYRVRNGLEPCVARAKAYAPYSDLIWMETGTPDLELAAKFAEGVKAEFPDQMLAYNCSPSFNWKKHLDDATIAKFQKELAAMGFKFQFITLAGFHALNYSMFDLAYGYARNQMTAYVELQEREFAAEERGYTATKHQREVGAGYFDRIATTVDPTSSTTALTGSTEEGQFH

SEQ ID NO: 5411 - protein, 287 aa, Mycobacterium paratuberculosis
VSDAAIQRVGVVGAGQMGSGIAEVSVRADVDVTVFETTEALITAGRNRIVKSLERGVSAGKVTERERDRALSKLTFTTDLKDLADRQLVIEAIIEDDAVKAQVFAELDRVVTDPDAVLASNTSSIPIMKLAAATKNPQRVLGLHFFNPVPVLPLVELVSTLVTDEAAAARTEEFASAVLGKQVVRCSDRSGFVVNALLVPYLLSAIRMVEAGFATVEDVDKAVVAGLSHPMGPLRLSDLVGLDTLKLIADKMFEEFKEPQYGAPPLLLRMVEAGRLGKKTGQGFYTY

SEQ ID NO: 5412 - protein, 286 aa, Mycobacterium paratuberculosis
MTGLEPYYEESQSIYDVSDEFFALFLDPTMAYTCAFFERDDMTLEEAQTAKFDLALGKLNLEPGMTLLDIGCGWGGALKRALEKYDFNVIGITLSRNQFEYSKKLLAGFPTDRNIEVRLQGWEEFDDKVDRIVTIGAFEAFKMERYSAFFDRAYDILPDDGRMLLHTILTYTQKQQHERGVSITMSDLRFMRFIGQEIFPGGQLPAQEDIFKFGEAAGFSVERVQLLREHYARTLNIWAANLEANKDKAIAIQSQAVYDRYMHYLTGCENFFRKGISNVGQFTLVK

SEQ ID NO: 5413 - protein, 288 aa, Mycobacterium paratuberculosis
MSVQLTPHFGNVKAHYDLSDDFFRLFLDPTQTYSCAYFERDDMTLEEAQIAKIDLALGKLKLEPGMTLLDIGCGWGATMRRAIEKYDVNVVGLTLSENQAEHVQKTFDAMDTPRTRRVLLEGWEKFHEPVDRIVSIGAFEHFGRQRYGRFFRMAYDVLPPGGIMLLHTIVRPSFKDARAKGMKLTHEIVEFSRFILAEIFPGGWLPTPQTVGEYGVTAGFDLTRVQSLQLHYARTLDLWAQALEANREQAIAIQSQEVYDRYMKYLTGCAKLFREGYTDVNQFTMEKK

SEQ ID NO: 5414 - protein, 235 aa, Mycobacterium paratuberculosis
VAEQITAASVKMDGRKRRWHQHKVDRRNELVDGTIDAIRRLGGALSMDEIAAEIGVSKTVLYRYFVDKNDLTTAVMMRFTQTTLIPNMAAALTSGLDGFDLTREVIRVYVETVANEPEPYRFVMSNSSASKSKVIADSERIIARMLAVLMRRRMQHAGMDTGGVEPWAYLIVGGVQLATHSWMSYPRMSRDELIDYLTMLSWNALKGIVEVGGSLEKFREEPHPSPIVPPREAAL

SEQ ID NO: 5415 - protein, 456 aa, Mycobacterium paratuberculosis
VSSHQSAGKIDDGVVAHRASGRTSFAESFAGADPQADAQRRVALRRMKAVALSFLIGATGLFLACRWAQAQPGVGAWVGYVGAAAEAGMVGALADWFAVTALFRHPLGIPIPHTAIIKRKKDQLGEGLGTFVRENFLSPEVVETKLRDAQVSGRLGKWLSEAAHAERVAGETATVLRVLVELLRDEDVQQVIDRMIVRRIAEPQWGPPVGRVLATLLAENRQEALIQLLADRAFQWSLNAGEVIQRVVERDQRVVERDSPTWSPRFIDHLVGDRIHRELMDFTDKVRRNPDHELRRSATRFLFEFADDLQHDPDTIARADAIKEQLMARDEIANAAATAWKTLKRLVLEGVDDPSSALRSRIADTVVRIGESLRDDADLRDKVDNWLVRAAQHLVSQYGVEITAIITDTIERWDAEEASRRIELHVGRDLQFIRINGTVVGSLAGLVIYAVAQLLF

SEQ ID NO: 5416 - protein, 138 aa, Mycobacterium paratuberculosis
VAPEEKLSAKVSNAASDMASDIGSFIRSQRELAQVSVRQLAEKSGVSNPYLSQVERGLRKPSADVLNQIAKALRVSAEVLYVRAGILEPSDKSQVRDAIVTDTAITERQKQILLDIYASFTQQNEATHEECPTQPDSE

SEQ ID NO: 5417 - protein, 195 aa, Mycobacterium paratuberculosis
MKGTTMAENPNIDDLRAPLLAALGAADLALATVNDLIANLRERAEETRAETRTRVEERRARLTKFQEDLPEQFTELRDKFTTEELRKAAEGYLEAATNRYNELVERGEAALQRLRSQTAFEDASARAEGYVDQAVELTQEALGTVASQTRAVGERAAKLVGIELPGKAEAAGKKAQKAIAKAPAKKAPAKKVTQK

SEQ ID NO: 5418 - protein, 87 aa, Mycobacterium paratuberculosis
MLVLQIAVLVTAIYAFVHAALQRPDAYTAADKLTKPVWLLILGGAVALTSVLGYVFGVLGMAIAACAAGVYLVDVRPKLLEIQGKSR

SEQ ID NO: 5419 - protein, 165 aa, Mycobacterium paratuberculosis
VRPGCIWSMCGPNSWKYRASRASGMRVPLAAPAALLLALCWPIAPAAAPDPGAGTADPPFIDHTDWAQWQGRSSLRVFPTPAGRTAAKTPGSMAMADEAWAEVLALAPDADTAGMRAQFLCHWQFAELGRPGKLSWNLEPWRPVVDDAEMVASGCNPGGPEESFG

SEQ ID NO: 5420 - protein, 223 aa, Mycobacterium paratuberculosis
MTPTRAQLAAFVDHTLLKPEATAADVAALVTEAAELGVYAVCVSPTMVPAAVQAGAGVRVASVAGFPSGKHVSAVKAHEAALAVASGAAEIDMVIDVGAALAGDLDGVRADIAAVRDAVGGAVLKVIVESSALLALADEHTLVRVCRAAEDAGADFVKTSTGFHPTGGASVRAVALMAEAVGGRLGVKASGGIRTAADALAMLDAGATRLGLSGTRAVLDGLG

SEQ ID NO: 5421 - protein, 352 aa, Mycobacterium paratuberculosis
VTNPQGPPNQDPSTWGRPANQGPYGQPPTERPTERINTGGPGQAPGQVPPPPPAPAPPPPGQTERFGAPRPQMQQPGYPPPPTPPAGPTERLATAPNPDNGPAKKKRRFLRDPVSVLLIFIIVFALLIAGFIGAELYVRHVADTKVAQAVACEVKDQATASFGVTPLMLWQQATKHYTNISVQTAGNNIRDAKGMKLSININDVRLKDNGNSKGTIGALDATIDWTTDGIKQSVQNAIPVLGPFVTNTVTTHPADGTIELKGMLDNITAKPVISGTGLQLQIVSFNALGFTMPKESVQSTLDDFTSNLTKNYPLGIHADSVQVTDKGVTSHFSTRNAAIPTGNNNDPCFANL

SEQ ID NO: 5422 - protein, 274 aa, Mycobacterium paratuberculosis
MRIALAQILSGTDPAANLALVGEYTRRAAGAGARLVVFPEATMCRFGVPLAPIAEPVDGPWADGVRRIATEANVTVIAGMFTPSGDGRVKNTLLVANSDDQAVTHYDKIHLYDAFGFTESRTVAPGREPVVVGVDGVRVGLSVCYDIRFPELYTELARRGAQLIAVCASWGAGPGKLDQWTLLARARALDSMSYIAAAGQADPGEILSASGAPTGVGGSLVASPLGEVVASAGAQPQLVLADIDVDRVAQARKTIAALSNRSDFAQVGRAESVG

SEQ ID NO: 5423 - protein, 174 aa, Mycobacterium paratuberculosis
MPRSFDLSAHYDGSVDEVHRAFTDADYWRARLASSGVDVATLESMRVGGQSGDEDVVEVVTLQVIRSDKLPGMVTQLHSGDLCIRREETWGPVTGGTATGSVVGSIVDAPVNLAGDAVLEPAEDTGGARLTFRATVQVRVPIIGGKLENFIGARLAELIAAEQRFTTEWIAQTA

SEQ ID NO: 5424 - protein, 372 aa, Mycobacterium paratuberculosis
MKSSGAGAAFAGASVADAAPLAPLTTLRVGPTARRLITCASSEQVIATLRRLDTERLAGQRDPVLVFAGGSNLVISDALSDLTAVRLANDGITVEGNLVRAQAGAVWDDVVLTAIEHGLGGLECLSGIPGSAGATPIQNVGAYGAEVSDTLTRVRVLDRGSGQVRWVPGTELEFGYRTSVFKRRADDGLEIPSVVLEVEFALDASGRSAPVRYGELAAELKVPVGQRADPRTVREAVLALRARKGMVLDAADHDTWSVGSFFTNPVVAPDVYERLAGSVDGPVPHYPAPGGVKLAAGWLVERAGFGKGYPVPDPGGPEAPCRLSTKHALALTNRGTARSDDVIALARTIRDGVRSVFGITLVPEPVLLGCRL

SEQ ID NO: 5425 - protein, 446 aa, Mycobacterium paratuberculosis
LIFVTPSSAPRPFNRRVALATLGIGALAPGVLAACGGGTAKEAEKKEQPALRLKYQPADAAQNVVPTAPVSVEVSDGWFQHVTLSNSSGKAVAGTFNSDRTVYTTTEPLGYDQTYTWSGSAVGHDGKTVAVAGKFSTVSPSKKISGAFQLADGQTVGIAAPIILQFDAPISDKAAVEKALTVTTNPPVEGSWAWLPDEAQGARAHWRTREYYPAGTTVNVQAKLYGLPFGDGAYGAEDISLNINIGRRQIVKAEVSSHRIQVIRDEGVIMDFPCSYGEADKARNVTRNGIHVVSEKYADFYMSNPAAGYSHVHERWAVRISNNGEFIHANPASAGAQGNTNVTNGCINLSTSDAEQYYQSAIYGDPVEVTGSSIQLSYADGDIWDWAVDWDTWVAMSALPPPTAHPPSTQIPVTAPVTPSNAPTLSGTPTTSTTTPASTGPATPGG

SEQ ID NO: 5426 - protein, 249 aa, Mycobacterium paratuberculosis
MVGTGRNERVAVVTGASSGIGEATARTLAAQGFHVVAVARRAERIHALANEIGGTAIVADVTDDAAVAALASKLSRVDVLVNNAGGARGLEPVAEADLEHWRWMWETNVIGTLRVTRALLPKLVDSGDGLIVTVTSVAALEVYDGGAGYTAAKHGQGALHRTLRGELLGKPVRLTEIAPGAVETEFSLVRFDGDQQRADAVYTGITPLVAADVAEVIGFVASRPAHVNLDLIVMKPRDQASASRFNRRG

SEQ ID NO: 5427 - protein, 428 aa, Mycobacterium paratuberculosis
VGHAPGPKPHRAVRRQIVPPALHIPESAAASVFRAVRLRGPVGRDVIANVTSLSIATVNRQVIALLEAGLLRERADLAVSGAIGRPRVPVEVNHEPFVTLGIHIGARTTSIVATDLFGRTLDTVETPTPRNPAGPALASLADSARRYLRRWHRRRPLWIGVAIGGTVDSATGQVDHPRLGWRQAPVGQVLADALGLPVSVASHVDAMAGAELLLGMRRFLPSSPTSLYVYARETVGYALVIGGRVHVPTSGPGTIATLPAHSELLGGTGQLESTVSDEAVVAVARQLRILPFAPANRASGSAAGIADLLRVARAGNEQARELLAERGRVLGEAVALLRDMLNPDELVVGGQAFTEYPEAMEQVEAAFAARSVLGPRDIRLTAFGNRVQEAGAGTVSLSGLYADPLSAMRRAGALDARLREVARDESSA

SEQ ID NO: 5428 - protein, 441 aa, Mycobacterium paratuberculosis
VCCALGPGGEPSCKDDRVRHDDVFRLNEPRRVAVLAVHTSPLAQPGTGDAGGMNVYVLQTALHLARRGIEVEIFTRATASADPPVQRVAPGVLVRNVVAGPFEGLDKYDLPTQLCAFAAGVLRAEASHEPGYYDIVHSHYWLSGQVGWLARDRWAVPLVHTAHTLAAVKNAALAQGDSPEPPLRTVGEQQVVDEADRLIVNTDDEARQLISIHHADPARIDVVHPGVDLDVFRPGDRRAARAALGLPLDKDIVAFVGRIQPLKAPDIVLRAAAKLPGVRIVVAGGPSGTGLASPDGLARLADELGISARVTFLPPQSRPNLATLFQAANLVAVPSYSESFGLVALEAQACGTPVAAAAVGGLPVAVRDGVTGTLVAGHDVDHWADALAGLLRAPAPAAAAMSRAAAAHAATFSWDHTTDALLASYRRAIREYTTERRGVGA

SEQ ID NO: 5429 - protein, 169 aa, Mycobacterium paratuberculosis
MSATVERVIEDTLQASGLTYSKHAGAHGGPSGLVVELPGERKLKTNTILSVGEHSVRVEAFVCRKPDENHEGVYRFLLKRNRRLYGVAYTLDNVGDIYLVGRMSLASVSGDEIDRVLGQVLEAVDSDFNTLLELGFRSSIQKEWEWRVSRGESLKNLQAFAHLIDDDEG

SEQ ID NO: 5430 - protein, 249 aa, Mycobacterium paratuberculosis
MGETATLVLLRHGESEWNSLNLFTGWVDVGLTDKGRAEAVRSGELLAEQGLLPDALYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGRG

SEQ ID NO: 5431 - protein, 409 aa, Mycobacterium paratuberculosis
VTVFSALLLAGVLSVLALAAGVAVGTRLSPRAAQRRQRISTEWTGITVAQMLERIVALMPLGAAVVDAHRDVVYLNDRAKELGLVRDRQLDDQAWEAAQQALTGVDVEFDLRPAKRSGGRAGLSVHGQARLLSEEDRRFAVVFAHDQSDYARMEATRRDFVANVSHELKTPVGAMALLAEALLASADDSETVRRFAEKVLVEANRLGDMVAELIELSRLQGAERLTNVTEVNVDSVVNEAISRHKVAADNANIEVRTDAPSGLRVLGDETLLVTALANLVSNAIAYSPPGSPVSISRRRRGDNIEIAVTDRGIGIALEDQERVFERFFRGDKARSRATGGSGLGLAIVKHVAANHNGTIGVWSKPGTGSTFTLSIPAAVASHRGDGESEQPQGRDVRPNRSQREEELSR

SEQ ID NO: 5432 - protein, 167 aa, Mycobacterium paratuberculosis
TDVCKQLRARSSVPVIMVTARDSEIDKVVGLELGADDYVTKPYSARELIARIRAVLRRGGDDDSEISDGVLESGPVRMDVERHVVSVNGDTITLPLKEFDLLEYLMRNSGRVLTRGQLIDRVWGADYVGDTKTLDVHVKRLRSKIEADPANPVHLVTVRGLGYKLEG

SEQ ID NO: 5433 - protein, 166 aa, Mycobacterium paratuberculosis
VTPVPDFIVELRRRIGHAPLWLPGITAVTIRGRKVLLVKRSDNGAWTAVTGIVEPGENPADCAAREVREETGVSARATRLAWVHVTRPAIHANGDHAQYLDHVFRMEWLSGEPFPADDESTAAAWFDLDELPPMTADMRRRITLSANDDERTVFDTDGPPPARPSG

SEQ ID NO: 5434 - protein, 314 aa, Mycobacterium paratuberculosis
VDDEKRSAAAPRRRGRPGRLEVWYATLSDPRTGAGLWVHCETVAPLRGAAYGHGWATWFPPDGPPRTGRFGPVPAHPATGPDWFACAGVRVADERLRGRAGALAWELSWTDPTRPLWTFPRLAWERELLPGAQVVLAPTAEFTGRLHLDGAPARVEGWRGGVAHIYGHGNARRWGWMHADLGGGDVLEVVSAVSHRPGLRRLAPLAFVRFRLDGNDWPASVLPSLRMRTRLQLPHWQLAGRIGGRRVCIRADLPPERCVSLGYTDPDGGTAVCTNTERADIRVEIDDRRWSVLGHAEVGLRGAEAPAVNERIPA

SEQ ID NO: 5435 - protein, 267 aa, Mycobacterium paratuberculosis
VDDVANSHPQPGQPGQEVELDFAREWVEFYDPDNPEHLIAADLTWLLSRWTCVFGTPACQGTVAGRPDDGCCSHGAFLSDDDDRARLDDAVKQLTDDDWQFREKGLGRKGYLELDEHDGQPQYRTRKHKDACIFLNRPGFAGGVGCALHSKALKLGVPPLTMKPDVCWQLPIRRSQEWVTRPDGTEILKTWVTEYDRRGWGSGGADLHWYCTGDPAAHVGATQVWESLADELTELLGAKAYAELAAMCKRRSKLGLIAVHPATRIAE

SEQ ID NO: 5436 - protein, 338 aa, Mycobacterium paratuberculosis
VRLGVLDVGSNTVHLLVVDAHRGGHPTPMSSTKATLRLAEATDSAGKITKRGAEKLISTIDEFAKIADSSGCEELMAFATSAVREAGNSEEVLNRVRKETGVELRVLTGVDESRLTFLAVRRWYGWSAGRIINLDIGGGSLEMSSGLDEEPEVALSLPLGAGRLTREWLPDDPPGRRRVAMLRDWLDAELAEASENILEAGTPDLTVATSKTFRSLARLTGAAPSGAGPRVKRTLTANGLRQLISFISRMTTADRAELEGVSAERAPQIVAGALVAEASMRALSIESVDICPWALREGLILRKLDSEADGTALMEPSVRNAGGQVVDRNQNRSRGDKP

SEQ ID NO: 5437 - protein, 322 aa, Mycobacterium paratuberculosis
MTGPHSETESPGTRPISVAELLARNGTIGAPAVTRRRRRRRGDSDAVTVAELTGEIPVIRDDEPDDQPGATDTVDTAAPAQPVAESAEPVAEDEPKTPYWSEPEPRWPKSPPQPKRAPGPERSAYPRPLPEPGPSANGTGRRSSGAEDMSPDPMDHYADIPVDVMDSEVREAEPALEDSAYVRSYLQSDSALDDDLDEDLDDDHADAATLTDEDLDAAHLEDEDAEAAHPAPGRLEAIWRGSVVVLQSILAVAFGAGLFVAFDQLWRWNSIVALVLSVLVILGLVVGVRVVRKTEDIASTLIAVAVGALITLGPLALSLQSG

SEQ ID NO: 5438 - protein, 280 aa, Mycobacterium paratuberculosis
VRPAIKVGLSTASVYPLRAEAAFEYAARLGYDGVELMVWAESVSQDIAAVKKLSRRYRVPVLSVHAPCLLISQRVWGANPIPKLDRSVRAAEQLGAQTVVVHPPFRWQRRYAEGFTEQVATLEAASDVMIAVENMFPFRADRFFGAGQSLERMRRRGGGPGPAISAFAPSYDPLDGHHAHYTLDLSHTATAGTDSLDMARRMGNGLVHLHLCDGNGLPADEHLVPGRGTQPTAEVCQMLAAGHFAGHVILEVSTSSARSATEREAMLAESLQFARTHLLR

SEQ ID NO: 5439 - protein, 280 aa, Mycobacterium paratuberculosis
MNALFTTAMTLREAGSGVYDGELDKRWTIGPKVHGGAMLALCANAARTACAGGPESAQQPVAVSASFLSAPDPGPMRLVTSIRKRGRRISVVDVELTQGERTAVHAVVNLGEPEHFPADGSAAIAKPLLSANPVTALMPPEPPDDIEPIGPGHPLAGLVHLGEGCDVRPVLSTMQPSADGRPPVIQMWARPRGVAPDALFALMCGDLSAPVTFAVDRTGWAPTIQLTAFLRGLPADGWLRIIATCTEIGHDWFDEDHTVVDSLGRLVVQARQLALVPAAP

SEQ ID NO: 5440 - protein, 298 aa, Mycobacterium paratuberculosis
VSAMLSGMARIAIIGGGSIGEALLSGLLRAGRQVKDLVVVERVPERAKYLADTYSVLITSVADAVENASFVVVAVKPADVESVMSEIARAAGQAESDTAEQVFVTVAAGVTIGYFESRLPAGTPVVRAMPNAAVLVGAGVTALAKGRFVTAPQLEGVSALFDSVGGVLSVPESQMDAVTALSGSGPAYFFLLVEALVDAGVAAGLSREVAADLTAQTMAGSAAMLLERMDADRRLGEAETPGLRVDATATQLRATVTSPGGTTAAGLRELERGGLRAAVDAAVQAAKMRSEQLRITSE

SEQ ID NO: 5441 - protein, 85 aa, Mycobacterium paratuberculosis
MTSTNGPSARDSAGKARDAGSGDGQQGRTQFLTVAEVAALMRVSKMTVYRLVHNGELPAVRVGRSFRVHAKAVHDMLETSYFDAG

SEQ ID NO: 5442 - protein, 375 aa, Mycobacterium paratuberculosis
VDPSNGHNSGPDDTAGNTVHYPKIVLVTGACRFLGGYLTARLAQNPMIKGVIAVDAIAPSKDMLRRMGRAEFVRADIRNPFIAKVIRNGDVDTVVHAAAASYAPRSGGTAALKEINVMGAMQLFAACQKAPSVRRVVLKSTSEVYGSSAHDPVMFTEDSTSRRPFRAGFAKDSLDIEAYARGLGRRRPDIAVTILRLANMIGPAMDTTLSRYLAGPLVPTILGRDARLQLLHEQDALGALERAAMAGKAGTFNIGADGIIMLSQAIRRAGRIPLPVPGFGVWALDSLRRANRYNEISRDQFDYLSYGRVMDTSRMRSELGYQPKWTTAEAFDDYVRGRGLTPIIDPDRVRSLESRAIALAQRWGSRNPIPWGGVR

SEQ ID NO: 5443 - protein, 354 aa, Mycobacterium paratuberculosis
VAGETRANVIPLHTNRGRVAARRRADQRAESARQHPSLLSDPSGRASAEQIAAVVREIDDHRRAAGASSPEAPLNELAQRVAAVAGFLRQRLTGDYSVDEFGFDPHFNSAIVRPLLRVFFRSWFRVEVSGIENLPAEGAALVVANHAGVLPFDGLMLSVAVHDEHPAHRDLRLLAADMVFDLPVVGEAARKAGHTMACTTDAHRLLAAGELTAVFPEGYKGLGKRFEDRYRLQRFGRGGFVTAALRTKAPIIPCSIIGSEEIYPMLTDVKLLARLFGLPYFPVTPLFPLAGPIGLVPLPSKWHIAFGEPIYTGDYAASDADDPMVTFELTDQVRETIQQTLYRLLAGRRNIFFG

SEQ ID NO: 5444 - protein, 299 aa, Mycobacterium paratuberculosis
MTSQGETQLKPPVEAVRSHYDKSNEFFKLWLDPSMTYSCGYWEEGAKTLEEAQYAKRKLALDKLNLEPGMTLLDIGCGWGSTMRHAMEEYDVDVIGLTLSENQYAHCVAEFDKMDSPRRKEVRIQGWEEFPDEPIDRIVSLGAFEHFADGAGDAGYERYATFFKKYYDLLPDDGRMLLHSIVVPTREEGNAMGLKVNMTLLRFISFILKEIYPGGKLPQVNLVDKYATDAGFKIERHHFIGKNYVPTLTAWGDALEAHKEEAIALKGQETYDIYLKYLRGCAELFRDGYTNVCQFTMVK

SEQ ID NO: 5445 - protein, 150 aa, Mycobacterium paratuberculosis
MTVPKEAEGLIGSHYRAPDYFEVGREKIREFALAVKDDHPAHFDESESAAAGYPDMVAPLTFLAIAGRRVQLEIFTKFSIPINIARVIHRDQKFKFHRPILAHDRLYFDTYLDSVIESHGTVLAEIRSEVTDADGKPIVTSVVTMLGEAA

SEQ ID NO: 5446 - protein, 303 aa, Mycobacterium paratuberculosis
MTSSDPVNADPTGHVDLESLAADASAARAIEGMQEAAATQDDRPQPPIDLTAAAFFDVDNTLVQGSSAVHFGRGLATRNYFTYSDVLGFIYAQAKFQVLGKENSNDVAAGRRKALAFIEGRSVEQLVALGEEIYDEIIADKIWPGTRELTQMHLDAGQQVWLITATPYELAATIARRLGLTGALGTVAESVDGVFTGRLVGDILHGTGKAHAVRSLAIREGLNLKRCTAYSDSYNDVPMLSLVGTAVAINPDARLRALARERGWEIRDFRTARKAARIGVPSALALGAAGGALAALASRRQSR

SEQ ID NO: 5447 - protein, 888 aa, Mycobacterium paratuberculosis
MAPLACDPTALDHAGATVVAAGESLGSVISTLTAALAGTSGMAGDDPVGAALGRRYDGAAAKLIQAMADTRNGLCSIGDGVRMSAHNYAVAEAMSDLAGRASALPAPQVTGPLTVGAPPSAVGHGSGAPAGWGWVAPYIGMIWPTGDSAKLRAAAAAWATAGANFMAAETAAGGGTMAAIGAQQIPEGAAINKALADASSATADVARQCQTIAAQLNSYAAKVDQVHAAILDLLSRICDPLTGIKEVWDLLTDEDEDEIKKIADDIRTVVDNFGREADTLGGQIEATVSAVAAATENMSHWAGKEWDHFLHGTPVGRALNQVGQAFKGVGEEGWGFLKGLYEVSPNRMLLDPVGYGKTMAGMVEGAGTLVGLGPDGVPGAFDAWKALGKDVTHWDEWGSNPAEALGKSTFDVATLALPGGPLSKLGKFGHTAADALKGLKKPPGVPKPPEVKPPAAPKAPDSGQPAPSGKPGPVAPSGKPAPGPADGPLPHSPTESKPPAGGTPPAAEPPKPTAAPHSGEPKPIATPPESVGKPVTPAPAEGAPAQPHEPVPAHAPASPGEPLATPAPAAAVPAAAAAPASAPAPAAAAAAPVPSASSVPMGGGAPAETPSGLGDVPHGGEPGAHPVEPPHDGAPHVPGGGDGPYHPGDGGPHGPGDGHPLADGSGPHQPGGHHPPGDGDRPPGSHPPHDGAPPDEPADGHPPEIPTPSDLPPWHQAQLALAESPEKLVKDLIEHGCPRELAESAGANSPYAGMTAQEILNKWWDPATGTWDWPKVEGFADGIYKTARSIPKDAWLDRIGEVSDAKGDFMGAVGDSYPHRGLAPGSSGDYNRFHGTGKELPEGWEVRYGEVGDAFGQPGGGTQWVVIDKNKKTVLIKWLIENGYLDWG

SEQ ID NO: 5448 - protein, 90 aa, Mycobacterium paratuberculosis
VDPAALADAVQRMAEFQRYAEDMIAEIDSRVTRLHQTWTGEGAAAHAEAHQHWVRGEAMMREALAQLGKAASTAHGNYTGAMSKNLGMWS

SEQ ID NO: 5449 - protein, 114 aa, Mycobacterium paratuberculosis
LVGRVTRHYVPAMSDNTVRVDPVVMQGAAASLSGAAEHLSAQLGQLDDQVGQMLGGWQGASGSAYAAAWELWHRGAREVQLGLAMLARLVGQAGEAYASNEAGAAQAERAVRGG

SEQ ID NO: 5450 - protein, 89 aa, Mycobacterium paratuberculosis
MTSATPRPQVELLTRDGCTICERIHARLVELAAELGFELSTTDVDAAAAAGNPGLRTEFGDRLPVILLDGREHSYWDIDEPRLRADLAR

SEQ ID NO: 5451 - protein, 459 aa, Mycobacterium paratuberculosis
VSVLLFGVSHRSAPVSVLEQLSIDESDHGKIVDRVLQSPLVTEAMVLSTCNRVEVYAVVDAFHGGLAVIGQVLSDHSGMSMSDLTKYAYVRYSEAAVEHLFAVASGLDSAVIGEQQVLGQVRRAYATAETNRTVGRVLHELAQRALSVGKRVHSETAIDAAGASVVSVALDMADRRLGGLAGKTAVLVGAGAMGALAAAHLSRAGIGQVHVLNRSLSRAQRLVRKIRETGVRADALPLEHLADALAGADVVVSCTGAVSPVVSLADVHHALAAAGRSAADETAHPLVICDLGMPRDVDPAVAGLPGVWVVDVDRVQHEPSAHAAAADVDAARTIVATEVAAYLAGQRMAEVTPTVTALRQRAADVVEAELLRLDNRLPGLDSAHREEVARTVRRVVDKLLHAPTVRIKQLASAPGGDSYAEALRELFELDQTAVDAVAAGELPVIATGFDAGAPQQPTE

SEQ ID NO: 5452 - protein, 315 aa, Mycobacterium paratuberculosis
VIRIGTRGSLLATTQAGGVRDALIARGHPAELVTITTAGDRSSGPIESLGVGVFTTALREAIEEGRVDAAVHSHKDLPTADDPRFAVAAIPARNDPRDAVVARDGLVLAELPPGSLVGTSSPRRAAQLRALGLGLEIRPLRGNLDTRLNRVSSGDLDAIVVARAGLARLGRLGDVTETLEPVQMLPAPAQGALAVECRAGDSRLAAVLAELDDADTRASVTAERALLAELEAGCSAPVGAIAEVVESIDEDGRIFEELSLRGCVAALDGSDVIRASGIGTPGRARELGLSVAAELFELGARELMSGARHDPARGN

SEQ ID NO: 5453 - protein, 552 aa, Mycobacterium paratuberculosis
MTTRGRKPTPGRITYVGSGPGDPGLLTARAATVLANAALVFTDPDVPEPVLALIGKDLPPVSGPAPAEPASNGEGSGSEQGQAQPAVISGGPDIRPALGDPAEVAKTLTAEARTGVDVVRLVAGDPLTVDAVITEVNAIARSHLHIEIVPGLAPTNAVPTYAGLPLGSSHTMADVRGDVDWEALAAAPGPLILQATASHLADAARTLIEHELAENTPCVVTAHGTTCQQRSIETTLQGLTDSAVLGGTDPAGPLTGPLVVTIGKTVSARTKLNWWESRALYGWTVLVPRTKDQAGEMSERLTSYGALPIEVPTIAVEPPRSPAQMERAVKGLVDGRFQWVVFTSTNAVRAVWEKFGEFGLDARAFSGVKIACVGESTADRVRAFGISPELVPAGEQSSLGLLDDFPPYDSVFDPVNRVLLPRADIATETLAEGLRERGWEIEDVTAYRTVRAAPPPAETREMIKTGGFDAVCFTSSSTVRNLVGIAGKPHARTIIACIGPKTAETAAEFGLRVDVQPETAAVGPLVDALAEHAARLRAEGALPPPRKKSRRR

SEQ ID NO: 5454 - protein, 326 aa, Mycobacterium paratuberculosis
MAYPRQRPRRLRSTPALRRLVAQTSLEPRHLVLPMFVADGIDEPRPIASMPKVVQHTRDSLRAAAASAVAAGVGGLMLFGVPRDEDKDPIGSAGTDPDGILNVALRDLAKDLGDATVLMADTCLDEFTDHGHCGVLDDRGRVDNDATVARYVNLAVAQAESGAHVVGPSGMMDGQVGAIRDGLDAAGFTDVVILAYAAKFASAFYGPFREAVSSSLSGDRRTYQQETGNSREALREIRLDLDEGADIVMVKPAMSYLDVVAAAAEVSPVPVAAYQVSGEYAMICAAAANNWIDERAAALESLTSIRRAGADIVLSYWAADAAGWLS

SEQ ID NO: 5455 - protein, 198 aa, Mycobacterium paratuberculosis
MRQGGCRETGLALTSDTTGDDVQPKRLFYEPGASWWWVACGPASAAAMVLIEIWSGAKVSLVVPAIFLVLVSAFVGLQVKAARIHVSVELTEEALRQGTETILVREIVKVYPEAENNEASGKELARWQSARALGELVGVPRGRIGIGLKLTNGRTAQAWARRHRQLRAALTPLVQERVEPSRTDVLDRDPDDDAGTAQ

SEQ ID NO: 5456 - protein, 146 aa, Mycobacterium paratuberculosis
MTIAGTETRHDNCVFDCDGAQVRAHHRHLATVVHIRGVIDDANVDRISHHIRRFTLGENPVVLDVADVTQFAEAGISLLYAFDADCRAAEVEWTLVASSAVTAVLDDTGHDASFPIMRSVHEVLRDRADAIAVRRRMALPLVKKTS

SEQ ID NO: 5457 - protein, 437 aa, Mycobacterium paratuberculosis
VRRPPRPLSRAARERNSRIQTGKSNVRGGEIRGEIKALTGLRIVAALWVVLFHFRPMLGDASPDLRDALAPVLNCGAQGVDLFFILSGFVLTYNYLDRMGRSFSTRATLHFLWLRLARVWPVYLVTLHLAALWVIFTLHVGHVPSPDAASLTAISYVRQILLVQLWFVPFFDDSSWDGPAWSISAEWLAYVLFAGLVLVLLRMKQATRARSLMVLAFAASLPPVVMLLASGHFYTPWSWLPRIVTQFTAGALACAAVRRLRLTDRGRRIAGYISLLLLAAMVGVLYWFGAHPISGVVENDSGGVVDVLFVPLVISLAVGLGSLPRVLSARAMVYGGKISFCLYMVHELVHTSWGWAVEQFELVTQDNPWKWNVIGLLAIALAGAVVLYHGVEEPARRWMRKMVDVRAVSARSDPGEPANTKLHPIDRPLEAISARAV

SEQ ID NO: 5458 - protein, 245 aa, Mycobacterium paratuberculosis
VRTRRRPAMPLTVEVGVSRLATFLIGVSLLLGVGLVAYPAQLRTYETLTLDFRLNHVAVIGDSYTTGTNEGGLGARSWPSRAWQVLSARGSRVSADVAAEGRAGYAVTGDHGSIFEDLTARAVQSDDALVVFFGSRNDQGVDPGLLIEKTHAALDLARRLAPAARLLVIGPPWPTADVPPSMYLIRDILGGAAGAAGATFIDPIAEHWFVGRPDLIGADGVHPNDAGHQYMADKIAPLIRTQLST

SEQ ID NO: 5459 - protein, 720 aa, Mycobacterium paratuberculosis
MTPRPESLASSPQPVERRGSRRGFRPDIEGLRAVAVIAVVLYHAGIPGIGGGYIGVDVFFVISGFLITGLLFREASTTNTVALGRFYGARARRLLPAAAIVGTVTAIGAAAVLPPLQARSVFLDGVASALYVGNYRFALRGTDYLTADAPSPFQHYWSLGVEEQFYLVWPLLIIAVAASVRRVRPLRATPRPVPYAVVLALIGAASLVAGVLWTRTSPSWAFFSLPTRAWELAAGGLVALSIQQWRRLSLRTASIARWGGLALILLTCTQLNAHTPYPGTEALLPVLGTALIIGGGAVTGGLGPGRLLCRPAMRAIGRISYSWYLWHWPVLLLMPALLGEPAGLPARLSATAVSAGLAVLTLHLVENPGRFAAALRRSAKVSLVVAGGASAATACACLVLLNVIPAPVGHGVAAPRANIIATPPSNVPAISAQEAAVRQAFAQARVILAAAAGVRAVPSNLDPPLAQAPANKAAVFVNGCVRSWRDVGQSECATGDTASPTTVALIGDSHAAMWNPAFEQLAGQRHWRLETLAKVTCPLAELHIVSPYLGREYTECEQWRAQIMARMNAEHPRLVVLDMSRRYGADFGFTSYDPAWIDTLGRTVAQLRGTGATVLVLGPSPDPHSSAPVCLSAHLDDVTACAPTRSAAIDGDGVAAEQAATLGNGGHYADLSDLFCTPDRCPLIVGNTLVFRDDNHVTTEYARLLAPVLGALADRALAEG

SEQ ID NO: 5460 - protein, 317 aa, Mycobacterium paratuberculosis
VTARSRQITQCLQYGVARRVMPAGRGIIAIMPDLTRRAVLRMGAGASLGAAGVFALSALLDPGTARAATLPQAPAPFEPPTAGKTLPTRLTGSFVSAARGGIKTNYVIAIPPGQTGMLRPVIALHGVDGDANQMLDMGVPDGLAQLVKAGKPPFAVVGVDGGNTYWHKRTSGEDSGAMVLDELLPMLSTMGFDTSRVGFMGWSMGGYGALRLGAKLGPSRTAGICAISPALYTSYATSAPGAFDSNEDFVQNSVLGLPALNSIPLRVDCGNFDRFYFATKQFVYQLKTPPAGSFSLGGHDIAFWRSQLPAELAWMAT

SEQ ID NO: 5461 - protein, 89 aa, Mycobacterium paratuberculosis
LRVRPPCTGVPSWSRCRRRARVETFEIASPRAAAISAGIGARQRRRRRPGPRCGGGTGGGRRRARSQARLRVLPRGTRWARRNMRTRGK

SEQ ID NO: 5462 - protein, 643 aa, Mycobacterium paratuberculosis
LSLAFHWFLPTYGDSRNLVAGGHGTPMSGDRPATLRYLHQICSAAEDNGFEAVLTPTGLWCEDAWLTTAMLVESTETLKFLVAFRPGLLSPTLASQMAGTFQRHSQGRLLLNVVTGGEPHEQRAYGDFLDKEARYARTAEFLHVVRQLWTSPQPVTFAGEHIRVEGAQLNNPPDPIPAVFFGGSSASAGPVAAKHSDVYLTWGEPLTAVAKKLDWVRGLAVDAGRILQYGLRIHVISRDTSDAAWAEADRLLSAIDPADIERVQASLARSESEGQRRMRELHGGNSGKLLVGPNLWAGVGLVRGGAGTALVGSHAEVAERLAEYAKLGITHFILSGYPHLEEAYWFGEGVLPLLERMGLWGTPIVGRVRRRRRRSRWPRRTDGHGSHLARAGARRARRRPSGRRIRRAAAPPTAHRGGRQPAGHHRRVVRLLPVRHGGRAGLQQGVLPERKFFGGNAIGVRDVCRRIRHAAHRGPGVRPHRRSDRPQAQPGADHAHHGRRDRADRGVADGRADRGLGAGAAAGVAGAAGVRARRRVGRGGAAGRRTQPGRPARPLRGGAAGRAGTRIGFGHRHIRFPADRAGPGPVPVLRLAHRVPVERTAGGHRHRGAVAGGRDTGVPGTAGPAGRVHRADPGHPARAAFPA

SEQ ID NO: 5463 - protein, 394 aa, Mycobacterium paratuberculosis
MAATLPAPAPAGLADGHPVDESAEQQRRRLRIVVAASLLGTTVEWYDFFLYATAAGLVFNKVFFPNESSLVGTLLAFATFAVGFVMRPIGGLVFGHIGDRIGRKRSLALTMLIMGGATALIGVLPTAAQIGAWAPVLLLVLRVLQGFALGGEWGGAVLLAVEHSPGDRRGRYGAVPQVGLALGLALGTGIFAFLQIVLGPARFLSYGWRIGFLLSVLLVAIGIVVRLRVEETPAFRELQDLQAASTVPIRDILRERRSRRNTVLGLLSRWAEGSAFNTWGVFAISYATGALGLNRVSVLIAVTIAALLMAVLLPVSGVLTDRFGARRVYLAGIACYGLAAFPAFALFGTKKLLWFGLAMVIVFGVVHALFYGAQGTLYSALYPTNTRYTGLSFV

SEQ ID NO: 5464 - protein, 50 aa, Mycobacterium paratuberculosis
VYASGVTPMILTALIAALGGAPWLACGYLVATAVISVLATALIRDRDLYL

SEQ ID NO: 5465 - protein, 316 aa, Mycobacterium paratuberculosis
MLALGGVIGAGLFVGSGVVIKDTGPAAFLTYALCGLLIVLVMRMLGEMAAANPSTGSFADYAAAALGRWAGFSVAWLYWYFWVIVVGFEAVAGGKVLNYWFHAPLWVLSLGLMLLMTATNLFSVSSFGEFEFWFAGIKVATIVIFLAVGAAYVVGLVPGHHDGLTNLVSHGGFFPRGVGAVFAAIVVVIFSMVGAEIVTVAAAESRDPRRAVQKATRSVVTRIGIFFVGSVFLLVAILPWDSVELGASPYVAALKHLGLAGADQVMNAVVLTAVLSCLNSGLYTASRMLFVLAERGEAPARLVRLSGRGVPHIAIL

SEQ ID NO: 5466 - protein, 105 aa, Mycobacterium paratuberculosis
MARVAPNTVFLFLLNSSGAIILFVYWLIALSQIVLRRRTPAERLSVKMWFFPVLSVLTLAGITAVLVQMAFDATARSQLWLSLLSWAVVVALYFVACSRGRVAAR

SEQ ID NO: 5467 - protein, 305 aa, Mycobacterium paratuberculosis
MKIAVIGCGAMGSIYAAKLAAAGEQVLAVDRHRPSVERINRDGLRVTGPGCDQVVPLRASTGAVDETMDLVVLAVKAADVEAAARQALPMLGPDTAVLTIQNGLGSAETVAGVVGTQRVAVGIASGFGASRVAPGHVHHNAMRAMRFGPYSSLPHARVESIARTWAHAGFDAVAVTDIAAMQWEKLICNVAYSAPCALTGMTVGQVMDDAEMGPVSRAAATEAWSVARASGVAIAVADAVEHVRAFGAQMPDAKPSALLDHEARRVSEIDVINGAVPRQGARVGVDAPVNATLTAVVKSIERRWR

SEQ ID NO: 5468 - protein, 394 aa, Mycobacterium paratuberculosis
LVRITGIVERAVRLDAPGRGGPANAVVDFSGHTVSLVAVLTDAVRRGRPVAGVAFDSIGRFAQSGILRDRLIPRVLAAAPDALLDGSGFLDPAAVAACALTDEKPGGHGDRAAAVAALELACWDLNAKLRDEPAWVTIARHAGRQPAPAVPVYAAGGYYHPAGGVDALRREMGEYLELGYRAVKMKIGGAALGEDLARVEAVIDVVGDAGRVAVDANGRFGRAEAIRWAGALAGYGLRWFEEPGDPLDYALHRAVTDCYDGPVATGENLFSVPDVTNLVRYGGMRPDHDVFQMDPGLSYGLSEYLRMLDVLADHGFDRGCAFPHGGHLINLHVAAGLGLGGCEAYPGVFAPFGGYPDGCVVSSGMIAPPDAAGFGLEQKPGLAELIAELTGERR

SEQ ID NO: 5469 - protein, 142 aa, Mycobacterium paratuberculosis
MSPGACELDGGMQLPQGLARFNRHVTNPIQRMWAGWLPPFGIVEHVGRRSGKPYRTPVNLFSADVDGKPGVAILLTYGPDRDWLKNLTAAGGGRIRSRGKTFGVADPRVVSKAEAASHLRPGVRGVFARLPFEQAVLLTRTP

SEQ ID NO: 5470 - protein, 115 aa, Mycobacterium paratuberculosis
VMGDTPGNAAGRRSSELSRRGRDLAAGKVITAADVQCAAERAETSRQRDLDAHRRDEHRHYQAAIAHERAAEVEDRAVAEGLGDVAAHQRAADREREAARRNFMAAQQANSYDAD

SEQ ID NO: 5471 - protein, 445 aa, Mycobacterium paratuberculosis
MGSSDQATAHARAQAASARLFDDACAVIPGGVNSPVRAFTAVGGTPPFITAARGCRLTDADGNHYVDLVCSWGPMILGHAHPAVVEAVAKAAASGLSFGAPTPAESELAAEMIARVAPVERIRLVNSGTEATMSAVRLARGFTGRAKIVKFSGCYHGHVDALLADAGSGVATLGLPSSPGVTGATAADTIVLPYNDIDAVRQAFTEFGDQIAAVITEASPGNMGVVPPAPGFNAALRALTADHGALLIVDEVMTGFRVSRSGWYGIDPVDADLFTFGKVMSGGLPAAAFGGRAEVMERLAPLGPVYQAGTLSGNPVAMAAGLATLRHADAAAYAALDANADRLARLLSDALTNAGVPHQIPRAGNMLSVFFTDTPVTDFASARATQTWRYPPFFHALLDAGVYPPCSAFETWFVSTALDDDAFDRIAAALPAAARAAAGADEGNS

SEQ ID NO: 5472 - protein, 202 aa, Mycobacterium paratuberculosis
MGEQTRVHVVRHGEVHNPDGVLYGRLPGFHLSEAGRAQAAAVAEALAPRDIVAVIASPLQRAQETAAPIAARHGLAVDTDPDLIESANFFEGRRISPGDGAWRDPRVWWQLRNPFRPSWGEPYTEIAARMETAVDKARARGTGHEVVCVSHQLPVWTLRLHLTGRRLWHDPRKRECGLCSITTLVYDGDRLVDVEYSEPAAP

SEQ ID NO: 5473 - protein, 197 aa, Mycobacterium paratuberculosis
LSARVLAMAGAVLAGLLTGCSSGHDAVAQGGTFEFVSPGGKTDIYYDPPSSRGRPGPLSGPDLADPAHTLSLDDPIFAGRVVVINIWGQWCGPCRSEVSQLQQVYDATRGAGASFLGIDVRDNNRQAALDFVNDRHVTFPSIYDPAMRTLIAFGGKYPTTVIPSTLVLDRQHRVAAVFLRELLATDLQPVVQRVAQQ

SEQ ID NO: 5474 - protein, 259 aa, Mycobacterium paratuberculosis
VTGLTQIAAAGPLLAALGVCLLAGLVSFASPCVVPLVPGYLSYLAALVGVEEQPQAGAVQAPPGARWRVAGSAALFVAGFTAVFVLGTVAVLGMTTTLITNQLLLQRAGGVLTIVMGLVFVGLIPALQRQARFSPRQLTTVAGAPLLGAVFALGWTPCLGPTLAGVITVASATDGASVARGIVLVIAYCLGLGIPFVLLAFGSAGAVAGLGWLRRHTRAIQIFGGVLLITVGALLVTGLWNDFVSWLRDAFVSDVRLPI

SEQ ID NO: 5475 - protein, 546 aa, Mycobacterium paratuberculosis
MALATLRATARNTWRALTSMGTALVLLFLLALGAIPGALLPQRNLNAGKVDDYLKAHPVIGPWLDRLQAFNVFSSFWFTAIYVLLFVSLVGCLTPRMIEHVRSLRATPVAAPRNLARLPKYAGHRIAADAEDLNTLANTLVGRLRGWRTAIRHHDGAGPDAVEVSAEKGYLREFGNIVFHFSLLGLLVAVAVGKLFGYEGNVIVIADGGPGFCSASPAAFDSFRAGNTVDGTSLHPLCIRVDDFDAHYLPSGQAVSFAANIDYQSGADLAANTWRHYRLQVNHPLRLGGDRVYLQGHGYAPTFSVTFPDGQIRTATVQWRPDNPQTLLSSGVVRIDPPAGSYPTAAERRQHEIAIQGLLAPTEQLDGTLLSSRFPALNAPAVAVDIYRGDTGLDTGRPQSLFTLDPRLIEQHRLTREKRVNLRAGQAVRIDQGPAAGTVIRFDGAVPFVNLQVSHDPGQTWVLVFAVTMMAGLLVSLLVRRRRVWVRLTPDAGGAPGTVNVELGGLARTDNSGWGDEFERLSQRLLDGLAEPASRASQRSTEVDVK

SEQ ID NO: 5476 - protein, 325 aa, Mycobacterium paratuberculosis
MNTVHVNIELARYSDWAFTSAVVALVIALLLLAFELAYAGGRRADARARVLAGAVSADSATPGVVDEVARRPVDERAGRAGLAVVYLGTGLLLACLVLRGLATLRVPWGNMYEFINLTCLCGLVAGAIVLRRPQYRPLWVFLLLPVLILLTVSGRWLYTNAAPVMPALQSYWLPIHVSVVSLGSGVFLVAGIASILFLLRTSPLGDPGNDSAPARLVRRFPDAQTLDRIAYRTTIFAFPVFGFGVIFGAIWAEEAWGRYWGWDPKETVSFVAWVIYAAYLHARSTAGWRDRKAAWINVAGFVAMVFNLFFVNLVTVGLHSYAGVG

SEQ ID NO: 5477 - protein, 441 aa, Mycobacterium paratuberculosis
RTTRGSAVSEHPTAGVGAPEEQTTQIPPAAAAGDEKKDAAEPQPEPGGDAPTKAFAGFRTERRVPAPEREPAPPTAPRPGGMPPWDSTPVTGIPRVDPTAYGAYYAGPDAPPTQIQGPPPRQEHLPHTPYPELSTGMLLRPVQPPPSEGWRLLLYKLSGGLINLGESPRAARYNNLVAQVNRPLRGSYRVAFLSLKGGVGKTTIAATLGATFASIRGDRVVAVDANPDRGTLSQKIPLETAATVRQLLHDAGTIERYSDVRRYTSKGPSGLEVLASETDPAVSEAFSADDYVRILDILERFYGLVLTDCGPGLLHSVMKSVLEKADALVVVSSASIDGARSASATLDWLDAHGHEDLVRNSIAVINGVRPRPGKVDMNKVIDHFSRRCRAVQLVPFDPHLEEGAEIDLDRLRRGTREALTELAAIVADGFPGAQRNPGVLG

SEQ ID NO: 5478 - protein, 61 aa, Mycobacterium paratuberculosis
MEVPRRFCVVYLLLVLILGTLIYVGWRAARSQAARPKTRVIGPDDDPDFLRRLGHGDNNPF

SEQ ID NO: 5479 - protein, 110 aa, Mycobacterium paratuberculosis
LAVSQQGSDGSTPGPGGAVVPVLAYAAARLLLAVVLTGVIYGVARLAGITEFPVVVAALFALVIAMPLGIWVFGPLRRRATAALAVAGERRRRERELLQARLHGDVPPER

SEQ ID NO: 5480 - protein, 148 aa, Mycobacterium paratuberculosis
VWGSDGTQATAIRQDIDWMDYLDRPTGPRPFLRLEGSAVFRWAAFEMGKVGQQAMDAAGVRPDEIDVFLPHQANSRINEILAKSLELRPDAVIANDIEHTGNTSAASIPLAMAEVLATGAAKAGDLALLIGYGAGLSYTAQVVRLPPG

SEQ ID NO: 5481 - protein, 172 aa, Mycobacterium paratuberculosis
MKQIAATSGPTNIGLLSVGSYRPQRVVTNDELCQNIDSSDEWIYSRTGIKTRRFAARDESTASMATEAGREAIAKAGLEASDIDCVVVATSTHFLQTPACGPAVAAALGATGVPAFDISAGCAGFGYALGVAADMVRGGTAGKVLVLGSEKLSPTVDMTDRSNCFIFADGAA

SEQ ID NO: 5482 - protein, 290 aa, Mycobacterium paratuberculosis
VANLGQWISGARPRTLPNALAPVVAGTGAAAWLHAAVWWKALLALVVAVAMTVGVNYANDYSDGIRGTDDDRAGPVRLVGSRLAAPRAVLGAAIVSLTVGAIAGLVLALSSAPWLIAVGAACIAGAWLYTGGSKPYGYTGFGEVAVFVFFGLVAVLGTEYTQALRVDWVGLVLAVAVGALSSSVLVANNLRDIPTDARSGKITLAVRLGDARTRVLYQALLSAAAALTLVLVAATPWCAAGLVATPLALRAATPVRSGRGGAELIPVLRDTGLAMVVWAVAVAAALTWGT

SEQ ID NO: 5483 - protein, 260 aa, Mycobacterium paratuberculosis
MHHNGRMLGVIGGSGFYTFFGSDADDVTVDTPYGPPSAPVTVGAVGGHRVAFLPRHEFSAHTVPYRANLWALRKLGVRRVLAPCAVGSLVPELGPGAVVVPDQLVDRTRGRADTYFDSGAVHVDFADPYCPALREAVTGLPGVVDGGTMVVIQGPRFSTRAESRWFASAGFSLVNMTGYPEAVLARELEICYAAIALVTDLDAGVSAGEGVKAVEVFAEFEKNIEPFKKLVRDAIGRVAAERSCTQCSPHTGVSLPIELP

SEQ ID NO: 5484 - protein, 156 aa, Mycobacterium paratuberculosis
MRVLVTGAAGFIGSRVAAALRAAGHDVVAVDALLAAAHGPNPLPPNGCHRVDVRDADALAPLLAGVDVVCHQAAMVGAGVDAADAPAYGGHNDLATTVLLAQMFAAGVRRLVLASSMVVYGQGGYRCERHGPVHPAAAAACGPGRRGLRAPVPDRR

SEQ ID NO: 5485 - protein, 145 aa, Mycobacterium paratuberculosis
VVALRYHNVYGPGMPRDTPYSGVAAIFRSALEKGEPPRVFEDGGQMRDFVHVDDVAAANLAALACRDGFTAVNVCSGQPISILQVATALCDARGGAVAPVVTGQYRSGDVRHIVADPSRAARLLGFRAAVQPGDGLREFAFAPLR

SEQ ID NO: 5486 - protein, 575 aa, Mycobacterium paratuberculosis
MVSQSSDDTPTGPIAGQPRQPAARRIIRSHATGATPPPGPATTGRRVAADLTAVALLLAAVLLPWNLYFGVGIPDSNPIVFTVLVAVTALALAALAVAGSWRAGGARFDPARAARLRLALNVPYLLLVLAFVGFDAVQTVRFGGTVDVPGGVGPGAWVGIAGALLSAQAVPAGTAAAPVPGTPGGDEATGWHRAARIIGALSMLAAVLSFGFNLYWRVRYALQSSGGAAQFGKENIAVIATAVVYGVVALVAVLVASRWLLRSDRASRLTTIALGTSTLGAGILVWLLPAGRDLDAFHGIAQNTSTAGVGFEGYLAWAAGAALFAPRSLFERRTPSHTEESAWRATARSGLLLIAVWALGSMAMRITDLAVAVTLNYPFSRYDSLVLAAFDLVTAVLAIWLRRRLANLAARLVTSLCGLVAALAVARVVVGVQLAPRFADTPNSPVHHPVYGNNLAQQITSVFDVTLCGLALGILVAAVVAGQLGRRRRARRSARRRAAQANAAAPTTRIPVSQGAAPSAAATTRIATGGPGADHEPPTTEIPPLAGSPRIFRGDDSGTRQIPVPKPQIYRPPQQ

SEQ ID NO: 5487 - protein, 559 aa, Mycobacterium paratuberculosis
MDVVLGVAVTGPVARLALVGSRGTDVIDQSVVDLADNPIETLTETVVGTNRLLAGENHRLVGTRLCWTDHPRADQLRRALGDSGVHNVAVLSESQAVAALMRAAGQPGAALVMDDATGTLSMVSPAAGDPDAPPTLLARQPLGGAVGGDVTAALQTMMANLSAHPDAPGEVYLVGASPDLDRVAEQLRDASTMRVQVADDPTFALARGAAIAAAPALAAGDATAMAPAVGVTGDATAMAPAAGDATAMAPAAGLTGDETTVVPAPELAEPQDRQLAYSMADDAGIYPGEMDEYDPEFDDYDADYDDGEEAAPAKLSRRSLVIGNAVIAFAVIGLASLATAIAVAVEPTASRQPVVGVQNGTPGKFMPILPSQQQAPLPPPPADAPNAGFQGGVVQAPSNAPAPQPAVPAPANPAPEAPSNPGVVPNPNPGWAPNPNPLVPVPIPIPVPIPGWNPPYNPPYTPPYNPTTPYTPPTTTYEPPTTTYQPPTTTYQPPTTTYQPPTTTYQPPTTTHEPPTTTYQPPSTRATTEAPLPTHTQQTVPPTHSQPLFPQEPHTHRGF

SEQ ID NO: 5488 - protein, 220 aa, Mycobacterium paratuberculosis
VPGTDGRVTVVLPCLNEEESLPGVLATIPPGYRALVVDNNSTDDTAGVARRHGAQVVTETRAGYGAAVHAGVLAATTPIVAVLDADGSMDGADLPRLVAALEAGADLVTGRRRPVPGLRWPWVARVGTVVMSWRLRTRHGLPVHDIAPMRVARRDALLGLGVADRRSGYPLELLVRAAAAGWRVVELDVRYGPRTGGKSKVSGSLRGSITAILDFWKVIS

SEQ ID NO: 5489 - protein, 218 aa, Mycobacterium paratuberculosis
VIPVTLLVVAKAPEPGRAKTRLAAAVGERAAAEIAAAALLDTLDAVAAAPVAARVVALTGDLDGAARGAEIRARLASFTVIAQRGNDFGARLANAHADAADGLPVLQIGMDTPQVTAELLAGCARRLLDAPAVLGLARDGGWWVLGVAAPVLADCLRAVPMSAADTGELTLKALRDNGIEVATVQTLVDVDVVGDVAVVRDACPPASRFARATRAAGL

SEQ ID NO: 5490 - protein, 458 aa, Mycobacterium paratuberculosis
VRIARRDAVAAAVGAALVAAAFLLPRLNLGVRQRLDVGPERFATHAGAAPIFGEWLIHAGWGTGPAVALAAAVVAWGPVLAQRLSWWALTLGSWAVAAGWAFALAMIDGWQRGFAGRLTTRDEYLWEVPGIHDIAAAVRTFSSRIVDYQPHSWTTHVSGHPPGALLTFVWLDRLGLHGGGWAGLLCLLAGSSAAAAVLIGVRALADEPTARRAAPFVALAPTAIWVAVSADGYFAGVAAWGIALLAVAVHRPVRFPALTAAGAGLLLGWGVFCNYGLMLMGLPAAAVLAAAPRLPRDGRTQWRAVLRALGPAALGAIAVAVAFAVAGFYWFDGYTLVQQRYWQGIAKDRPFQYWSWANLACVVCAIGLGGVAGVGRVFDRAAIRRRSGFPLLLLAVLAAIACADLSMLSKAEVERIWLPFTIWLTAAAALLPVRTHRIWLALNAVGALAVNTIILTHW

SEQ ID NO: 5491 - protein, 363 aa, Mycobacterium paratuberculosis
VLDGRDPALVVLGPPGDRESATLRAGLRVGEPVDDDVALVAATSGTTGAPKGAMLTAAALRASATATHERLGGPGSWLLALPAHHIAGVQVLVRSLLAGSTPVELDVSRGFDVTQLPAATRALGTGRRYASLVAVQLAKALGDPAATAALAELDAVLLGGGPAPRPVLQAAAAAGITVVRSYGMSETAGGCVYDGVPLDGVRVRVSDGRIALGGATLAKGYRNPVDPDPFAEPGWFLTDDLGAVDDDGVLTVFGRADDAISTGGLTVLPQPVEAALCTHPAVADCAVFGLPDDRLGQRVVAAIVLRDGRAAPSPDALRAHLSRTLDATAAPREVHVVAALPRRGIGKVDRAALVRRFAGGGEQ

SEQ ID NO: 5492 - protein, 100 aa, Mycobacterium paratuberculosis
VNGFLSSIVSWLRAGYPEGVPPTDTFPVLALLARRLSGDEVKDVASELIRRGEFDDVDIGVLITQITDELPTPDDVERVRVRLAAQGWPFDDADQAGDPA

SEQ ID NO: 5493 - protein, 102 aa, Mycobacterium paratuberculosis
MSHLGDWFNYQASLKILLFAMLAGAALPGLFALGIRLQSAGAGDITLDGADGGPARRNPLLTGLAWAIYALVIAVITLALLYIARDFIAHHTGYPFLGAKAK

SEQ ID NO: 5494 - protein, 422 aa, Mycobacterium paratuberculosis
LPLPPESGAVNIQLFLLIIVVITALAFDFTNGFHDTGNAMATSIASGALKPKTAVALSAVLNLVGAFMSTAVAATIAKGLIDSNIVTLELVFAGLVGGVVWNLLTWLLGIPSSSSHALIGGIVGATIAAVGAHGVIWKGVISKAIIPAIVSAILAILVGAVATWLVYRITRGVPKKRTEAGFRRGQIGSASLVSLAHGTNDAQKTMGIIFLALISYGSVSKTAAMPPLWVIVSCALAMATGTYLGGWRIIRTLGKGLVEIQSPQGMAAESSSAAVILLSAHFGYALSTTQVCTGSVLGSGLGKPGGEVRWGVAGRMGVAWLVTLPLAGLVGAVTYWIVHLIGGYPGAIIGFALLVAVSATIYLRSRKVKVDHHNVNAEWKGDLTTGLEGADDHSPPPDAGPPFGGPGDRYQSDDPTLKASAS

SEQ ID NO: 5495 - protein, 135 aa, Mycobacterium paratuberculosis
MEILASRMLLRPADYQQSLTFYRDRIGLAIAREYSGGTVFFAGQSLLELAGYGAPDHSGGPFPGALWLQVRDLEATQAELRGRGVAIAREARQEPWGLHEMHVVDPDGITLIFIQIPADHPLRRDTRGERQAKPG

SEQ ID NO: 5496 - protein, 298 aa, Mycobacterium paratuberculosis
VSKSPLRRFADQLVLATMRPPMAPQVLVNRPLIKPVELAGKRVLLTGASSGIGEAAAEQFAREGARVVVVARRKDLLDALAERITRAGGEAIAMPCDISDLDAADALVADVQQRLGGVDILINNAGRSIRRPLAESLERWHDVERTMVLNYYAPLRLIRGIAPGMIERGDGHIINVSTWGVLSEASPLFAVYNASKAALSTVSRVVETEWGDKGVHSSTLYYPLVATPMIAPTKAYQGVPALTPEEAGRWMITAARTRPVRIAPRMAIAAKALDTFGPRWVNAVMQRQTVQPNREAGA

SEQ ID NO: 5497 - protein, 300 aa, Mycobacterium paratuberculosis
MSDNPFDSGQWQPVAGFDDLTDITYHRHVDDATVRVAFDRPEVRNAFRPHTVDELYRVLDHARMSPDVGVVLLTGNGPSPKDGGWAFCSGGDQRIRGRSGYQYASGETADTVDPARAGRLHILEVQRLIRFMPKVVICLVNGWAAGGGHSLHVVCDLTLASREHARFKQTDADVGSFDGGYGSAYLARQVGQKFAREIFFLGREYTAEQMHHMGAVNAVVEHAELERAGIEWAREINAKSPQAQRMLKFAFNLLDDGLVGQQLFAGEATRLAYMTDEAVEGRDAFLEKRPPDYSRFPRYF

SEQ ID NO: 5498 - protein, 56 aa, Mycobacterium paratuberculosis
MTELSAAEARPVLRAFPTEVPTGVGFMKRAGLVTDGRPEEFEALAGRCAVFRLDPA

SEQ ID NO: 5499 - protein, 306 aa, Mycobacterium paratuberculosis
MTDKPRPGGIGDLGGLPVARVGYGAMQLFDTSPDEAAAVLRRAVELGVNHIDTASFYGPGEVNRRVRAALAPYPDDLVIVSKVGARYTGEQPIPLASAQRPAELRAAVEDDLSQLGLDRIPVVNLRRMDLGPSAAAGGDQDVDLDDQLAEMIALRDEGKIGGIGISSVPLEVLRRALPAGIVCVQNAYSLLDRSQEAMVDVCAAEGIAWVPYFPLGSAFPGLPKVTDNAVVVDIAGELGVTPAQVGLAWILARAPHTLLIPGTRSITHLEENMGAAGVTLSAEAIARLDAVGSAAGHDYAVTGGHQ

SEQ ID NO: 5500 - protein, 209 aa, Mycobacterium paratuberculosis
MVAPEGCGETLENAEGPPHSQPSRNGGSSALVGRSDARRNRQRLLEAATAAFTAHGASVSLESIARDAGVGIGTLYRHFPNREALVEAVYRAELAEVAAAAAQLLQRHPPKTALRRWMDRYANFVATKRGMAESLQAIFESGALVPSQTRDSIVGAVETLLRAGADDASLRADVQADDVVSSLIGIFLVSGSPEQTGRMLDLLVAGVTR

SEQ ID NO: 5501 - protein, 533 aa, Mycobacterium paratuberculosis
MGDELLRHPIHSGHLTVGALKRNKDKPVLHLGDTTLTGGQLAERISQYIQAFEALGAGTGATVGLLSLNRPEVLMIIGAGQTQGYRRVALHPLGSLDDHAYVLDDAGVTSLIIDPTPAFVERALGLLEKVPGLKQILTIGPVPEALSGSAVDLVAEAAKYAPKPLVAADLPPDHIGGMAYTGGTTGKPKGVLGTAQSITTMTTIQLAEWEWPENPRFLMCTPLSHAGAAFFVPTIIKGGELVVLTKFDPAEVLRVIEEQKITATMLVPSMIYALMDHPDSHTRDLSSLETVYYGASAMNPVRLAEAIRRFGPIFAQYYGQSEAPMVISYLAKKDHDEKRLTSCGRPTLFARTALLDADGNPVPQGEVGEICVSGPLLSGGYWNLPEETAKTFKDGWLHTGDMAREDEDGFWFIVDRVKDMIVTGGFNVFPREVEDVVAEHPAVAQVCVIGTPDEKWGEAVTAVIVLRPDHPSDEESVAKVTAEIQAAVKKRKGSVQSPKQVIVVDSVPVTALGKPDKKAVRARFWEGAGRAVG

SEQ ID NO: 5502 - protein, 574 aa, Mycobacterium paratuberculosis
MAWLLLIAWLCIVAGATHGARLERVAIPVSRTLGPIASVHMGQADLVLTGTVLTVDEARPTAEALAVADGRIVAVGTRAEIAAHVGPHTQTVDIGDGCVMPGFVEAHGHPLMEAVALSDRIVDIRPVTLANADDVVAAVKSEVGKRGEAGAYLNGWDPLLQQGLPQPTLAWLDDIAPDGPLVIIHNSGHKAFFNSRAAQRHGLNRDTPDPKGARYGRDADGELDGTAEETGAVFPLLDGAIDTAGYPRMLHAECARLNRAGLTTCSEMAFDPRFRPLVEQLRGQLTVRLRSYEISNPQLRTDATLGEGDDMLRQVGIKIWVDGSPWIGNIALSFPYLDTEATRTIGVIPGSCGCANYTTEQLHEIVSAYFPLGWQLACHVQGDAGVDTILDVYEEALKRHPRDDHRLRLEHVGAIRPDQLQRAADLGVTCSIFVDQIHYWGDVLVDGLFGEERGSRWMPAGSAVATGMRISLHNDPPVTPEEPLRNISVAATRKAPSGRVLAPEERLTVEQAIRAQTLDAAWQLFADDVIGSLEVGKYADLVVLSADPRAVPPERIADLQVRATYLAGRRVYPQ

SEQ ID NO: 5503 - protein, 326 aa, Mycobacterium paratuberculosis
VIPPLQDLLDRLHVVALPMRVRFRGITTREVALIDGPAGWGEFGAFVEYGPPEAAHWLASAVESAYRPAPPVRRDRIPINATVPAVPPAAVPDVLARFPGARTAKVKVAEPGQTLADDVARVNAVRDLVPTVRVDANGGWSVDEAARAARALSADGPLEYLEQPCATVGELAELRRRPDMPDVPIAADESIRKADDPLAVVHARAADIAVLKVAPLGGISALLDIAARIDIPVVISSALDSAVGIAAGLTAAAALPVLGHACGLGTGGLFVEDVADVAAPVDGALPVGPVTPDPARLRALAAPPQRRQWWIDRVTACHGLLVPSSG

SEQ ID NO: 5504 - protein, 261 aa, Mycobacterium paratuberculosis
VINLAYDDRGSGEPVVFIAGHGGAGRTWHPYQVPAFLAAGYRVITFDNRDIGATENAQGFTTETMVADTAALIEGLNAAPARIVGMSMGAFIAQELMLARPELVSAAVLMGTRGRMDRARQFFRDAEAELADGGVALPASYEAKIRLLENFSRKTLNDDTAVADWIAMFSTWPVKSTPGMRAQLDVAPYTNRLSAYRSIATPVLVIGFSDDVLTPPYLGREVADALPNGRYVQIPDTGHLGFFERADAVNAAMLKFFGEQH

SEQ ID NO: 5505 - protein, 207 aa, Mycobacterium paratuberculosis
VNPSTTQARVVVDELIRGGVRDVVLCPGSRNAPLAFALADADRAGRIRLHVRIDERTAGYLAIGLAIAAGAPVCVAMTSGTAVANLGPAVVEANYARVPLIVLSANRPYELLGTGANQTMEQLGYFGTQVRAAISLGLAEDAPERLDALNATWRSATCRVLAAATGSRTANAGPVQFDIPLREPLVPDPEPHGAPTPAGPPRAAGPV

SEQ ID NO: 5506 - protein, 340 aa, Mycobacterium paratuberculosis
VTYTPPVSFDQPLDIDLSPDTVVIAGHGAGTHPNLAQLPTVAEPTAPAPDNPLHPLALRLLRPKQVIMLGRPTLHRPVSALLADPQVPVYALTTGPRWPDVSGNSQATGTRAVTTGAPSPAWLHRCEQANRHAVAAVRGQLAAHPLTTGLHVAAAVADALRPGDQLVLGASNPVRDAALVGLDSHHIRVRSNRGVAGIDGTVSTAIGAALAHEAAHDGRTVALIGDLTFVHDSSGLLIGPTEPTPRRLTIVVSNDNGGGIFELLEQGDPRFSDVSSRVFGTPHDVDVGALCRAYHVESAQIEVGELAAALDEPGPGMRVLEVKADRSSLRQLHAAIKAAL

SEQ ID NO: 5507 - protein, 174 aa, Mycobacterium paratuberculosis
VTISPKALLHILIHGRSDPPETTRGRIALRWARIAVLIVTGLVTLQSVLLVAGAWRNDLAITHNMGVAQAEVLSAGPRRSTIEFVTPERVTYRPELGVLYPSHLATGMRIYVEYNKNDPNLVRVQHRNAGLAIIPAGSIAVVGWLGAAVLLALLALADKWLDRRGKGAGPADFA

SEQ ID NO: 5508 - protein, 384 aa, Mycobacterium paratuberculosis
VRVAIVAESFLPEVNGVSNSVIRVLEHLRRTGHEALVIAPDTPPGQPRAERIHDGIRVHRVPSRMFPKVTTLPLGVPTPRLVSVLRGFDPHVVHLASPALLGYGGLRAARWLGVPTVAVYQTDVPGFAASYGIPMTARAAWAWFRHLHTLADRTLAPSTVTMESLVAHRFPRVHRWARGVDVLRFAPSARSEALRRRWSPQGKPIVGFVGRLAPEKHVERLAGLAASDAVQLVVVGDGVDRAKLQSAMPTAVFTGALYGDELAAAYASMDVFVHPGEHETFCQVVQEALASGLPVIAPDAGGPRDLVTPWRTGLLLAVDEFETKLPAAVAHLIGERHRYAPAARRSVLGRSWPVICDELLGHYEAVLSPFVRHQVRAGRYAQGE

SEQ ID NO: 5509 - protein, 261 aa, Mycobacterium paratuberculosis
VTCTPNGAISSHAEVQRWRRRGIPAPGSVKRVSRAELDKNPRDVASMFDGVARRYDLTNTVLSLGQDRYWRKATRSALGIGPGQKVLDLAAGTAVSTVELNKSGAWCVAADFSVGMLAAGAARRVPKVAGDATRLPFADDVFDAVTISFGLRNVVDTQAALREMARVTRPGGRLVVCEFSTPSNALFATVYKEYLMRALPRVARAVSSNPDAYVYLAESIRAWPDQAALADQIAGAGWAGVRWRNLTGGIVALHAAHRPPR

SEQ ID NO: 5510 - protein, 130 aa, Mycobacterium paratuberculosis
MLATIGAAAVAAFALAAPAQLSAPAQADPPPTAPYPTPRTPSPPSDYDAPFKNTVNGFGIYQPQDQLAWLGKITCDRLDHGVDHDAHQSATFIQRNLPRGTSEGQSLQFLGAAVDHYCPEHIDVVQAAGR

SEQ ID NO: 5511 - protein, 412 aa, Mycobacterium paratuberculosis
MTTAATRADLVVVGAGPAGSAAAAWAARAGHDVLVVDAARFPRDKACGDGLTPRAVAECERLGLGGWLDSRIRHRGLRMSGFGAQVQVDWPGPSFPSTGSAVARTELDDRIRRVAEDSGARMLLGTKAVGVQRDSSGAVRALTLADGTGVQCRQLIVADGARSSLGRALGRRWHQETVYGVAARGYLSTPHADDPWLTSHLELRGPDGARDKVLPGYGWIFPLGNGEVNIGVGALSTSRRPAELALRPLIDHYTDLRRDEWGFVGRPRAVASALLPMGGAVSGVAGPNWMLIGDAAACVNPLNGEGIDYGMETGRLAAGLLGCPDLSQEWPALLREHYARGFSVARRLALLLTYQRFLPATGPVAMRSTTLMRIAVRVMANLVTDDDADWVARAWRGAGRLSRLIDRRAPFS

SEQ ID NO: 5512 - protein, 335 aa, Mycobacterium paratuberculosis
VNTPATVVAGVDFGDPAFAATVRDGVGRIEQLMDTELRSADDIMTESLTHLFKAGGKRFRPLFTVLSAQIGPDPDAAEVTIAGAVIELVHLATLYHDDVMDEAEVRRGTPTANVRWGNNVAILAGDYLFATASRLVSRLGPEAVRLIAETFAQLVTGQMRETRGRKQGSDPIEHYLKVVYEKTACLIAAAGRFGAMFSGADADQVERLSRLGGIVGTAFQISDDIIDIDSDSHESGKLPGTDVREGVHTLPMVYALREPGPDAARLRELLVGPIDDDEVVAEALTLLRASPGMAKAKQSLREYAAQAHRELDQLPDVPGRRALQTLVDFTISRHG

SEQ ID NO: 5513 - protein, 287 aa, Mycobacterium paratuberculosis
MTWHPHANRFKTFALLVGMSALIVFVGSLFGRTAMFFAVLFAIGMNVYTYYNSDKLALRAMHAQPVSELQAPAMYRIVRELATAAHQPMPRLYISDTNAPNAFATGRNPRNAAVCCTTGILGILNERELRAVLGHELSHVYNRDILISCIAGAMASVITALANMAMFAGMFGGNDRDGENPFALLLVSLLGPIAATVVRLAVSRSREYQADESGAVLTGDPLALASALRKISGGVQAAPLPPEPQLASQAHLMIANPFRAGERIGSLFSTHPPIEDRIRRLESMAGR

SEQ ID NO: 5514 - protein, 511 aa, Mycobacterium paratuberculosis
MQDIQRADDALPTASRAERLRGVIRHDLPSSLVVFLVALPLSLGIAIASNAPVLAGLIAAIVGGIVVGALGGSPLQVSGPAAGLTVVVAGLVSDFGWGVTCFITVAAGAVQVLLGLSRVARAALAISPVVVHAMLAGIGITIALQQTHVLLGGKSKSTAWHNLIGLPGQIIGAHRPGVLLGVLVIVILVAWRWVPAKVRRVPGPLVAIVAVTVISVVFPFHVRRIDLDGSPLDALQLPDLPHGNWSGVAVGVITVALIASVESLLSAVSVDRMHNGPRTDFNRELVGQGAANMISGAVGGLPVTGVIVRSSTNVNAGARSRASAIMHGVWILLFTIPFAGLVDEIPTAALAGLLIVIGIQLLKPAHIETAMKHGDLAVYVVTAVSVIFLNLLHGVMIGLALAIALTGWRVIRAKIEAAQLDGEWRVTIEGAACTFLALPRLTRVLASVPRGATVTVAIAVHYLDHAAHQAITDWQRQQEATGGTVRIEGAVVATGRRDEPQVEAEMPGAAA

SEQ ID NO: 5515 - protein, 332 aa, Mycobacterium paratuberculosis
MAAQMREPKVVVLGGGSWGTTVASICARRGPTLQWVRSRETADDINENHRNSRYLGNDVVLSDTLRATTDFCEAANTADVVVTGVPSHGFRGVLTELARELRPWVPVVSLVKGLEQGTNMRMSQIVEEVLPGHPAGILAGPNIAREVAEGYAAAAVLAMPDQHLATRLSGLFRTRRFRVYTTDDVVGAEMAGALKNVFAIAVGMGYSLGIALVIARALREMTKLGVAMGGSPDTFPGLAGLGDLIVTCTSQRSRNRHVGEQLGAGKPIDEIIASMNQVAEGVKAASVIMEFGLTMPIAREVDAVINHGSTVEQAYRGLIAEVPGHEVHGSGF

SEQ ID NO: 5516 - protein, 506 aa, Mycobacterium paratuberculosis
MTVTPQEAADHGAAEADYFDVLIVGAGISGIDAAYRITERNPQLSYAILERRARIGGTWDLFRYPGVRSDSSIFTLSFPFEPWTRKEGVADGVHIREYLTATAHKYGIDRHIRFNSYVRSADWDSTSDTWTVTVEDGARDGERKLYRARFLFFGSGYYNYDEGYTPDFPGIEEFTGTVVHPQHWPEDLDYTGKKVVVIGSGATAVTLLPSLSDRAAKVTMLQRSPTYLISASKYGKVAAVARKVLPRKPAHLVIRMYSALTEAVFFALSRKAPRLVRWLLRRKAINSLPPGYAVDIHFKPRYNPWDQRMCLIPDADLYNAITAGRADVVTDHIDHFDATGIALRSGAHLDADIIITATGLQLQALGGATISLDGNEIKTNDRFVYKAHMLEDVPNLFWCVGYTNASWTLRADITARATAKLLEHMTTHGYTHAYPHRGNEPMTEKPSWDINAGYVLRSVHALPKSGTKRPWNVRQNYLADAIDYRFDRIEEAMVFGRAADRAALAG

SEQ ID NO: 5517 - protein, 163 aa, Mycobacterium paratuberculosis
MADSSFDIVSKVDRQEVDNALNQAAKELATRFDFRGTDTTIAWKGDEAIELTSSTGERVKAAVDVFKEKLIRRDISMKAFDAGEPQASGKTYKVNGTLKQGISSESAKKITKLIRDEGPKGVKTQIQGDEIRVSSKKRDDLQAVIAMLKQADLDVALQFVNYR

SEQ ID NO: 5518 - protein, 313 aa, Mycobacterium paratuberculosis
MTVPNDDTWGPATSVGTTATMAAAARAIATRDGVINDPFAEPLVRAVGVNFLTRWAIGELVASDVDVEGSPWGLAQMPASIAARTRYFDEFYADAAAAGIRQAVILASGLDTRAYRLDWPAGMTVFEIDQPAVIEFKTTALARLGAEPKADLRTVAVDLRDDWSTALATAGLDSSKPTAWIAEGLFGYLAPEAQDGLLDAVTALSTPGSRLGSEAVPNTADMDPHAARERMRAATAKWRDHGFELDVDVISFAGERHDVGAYLQAHGWTTVATPMAELLADHGLPAIARADDDRQTMNGVTYYTSTLGTGRQR

SEQ ID NO: 5519 - protein, 453 aa, Mycobacterium paratuberculosis
LAIIHGADRGARPQSWEEVARVTETTTQPVADAVADRPSVSLRTRGRWLRWGLLSVWGPGLVVMLADTDAGSLITASQSGAQWGYRMVLPQLILMPVLYVVQEMTVRLGIVTGRGHGSLIRERFGRGWAWLSAFTLFASAIGALLTEFAGVAGVGELFGVSRWVSIPVATIALLALALTGSYRRVERIGLAVGAAELAFLVAMVMARPDPGALAHGLTSMPLGDSSYLLLIAANVGAVIMPWMIFYQQGAVVDKHLSESTIRQARYDTAFGAVLTQLIMIAVVITMASTIGRHGDGAPLETVGQIAQSLTPYLGHVGGTVLFGLGMLGAALVAAIVASLAGAWGLAEVFGWKHTLNQRPNRATAKFYLTYSLAHIVGAVLVLASVDLVNLAVDVEIMNALLLPIVLGLLLALEARALPEQWRMRGLHKHVTRALCLVTIGFGLYMVPQALGWA

SEQ ID NO: 5520 - protein, 480 aa, Mycobacterium paratuberculosis; identical to SEQ ID NO: 2670

SEQ ID NO: 5521 - protein, 485 aa, Mycobacterium paratuberculosis
VEADGEPERADEPAHRVRPIIAAGRTSRATGRGGRTLLWLRTHWGIFMRAARRSTARRRPAASRGAALAALGCLALASCSDTVPAPPLSATTSTSKSTSKAGPDSAAAPSMTGPLEKDWKSYGGTAYFGCPQRFSFSKSALQDIRPKVFDPKTGQYLAPGVPSVPAGETVTGAICALTGTAEQLRVVYIVTTAAKTIGYVFDLTSGQPLVTKDLQAPAPDQRLAAPKDWSLASTASGVAWLNAVTDGHAAAAPPRTVVLSGQDLSTLWSDPEPARVWPDVLAFTRSGDPAQTPGTRLRLPGGEEIYQDNDVVSVDAELTDGSSKLVQLTRRDPANPAEVSTLFYDLDAKSVIKIGDSERISGGGLTAALSDGKLFVDGHNRDNSQFGFGVWNLRGQQWDFLKNRDDARKLSLAKVAFFEDHLYLTGSGGTFSVIALPAGDPVASNWALRPFQRISGWTLVCRGETAPGANGECKEILNDVVKPPR

SEQ ID NO: 5522 - protein, 409 aa, Mycobacterium paratuberculosis
MTVGAAPPSVFDSDLPTLHYHSDETPAQVYPRLREAQRRAAVAIGPHGPEVLSYHLVRSVLRDPRFQIPPGINLLAQGIDSGPLWDKVANSLLCLEGDAHHRLRSLCSKAFTPRTVARLHDTMAAVMNELVDRVAAAGRCDVVTDIARPYPVPIICALLGAPREDWRRFSSWADDVFKAFSFTVDLREVEPVVMRAWRELDDYVDEMVARRRHNLTDDLLSDLIRVGDEGDRLDAAELRMLAGGLLLAGTDTTRNQVAASVQVLCEHPDQWELLRQRPELAMRAVEETMRHSPIACGTLRLVVEDAELDGHLFPAGTAVLVNTFAANRDPVVYNDPDRVDITREAAPPILTFGGGVHYCLGANLARREIAEALNVLANRLRNPRLAGPAPWKPMVSLSGPTSLPIEFDR

SEQ ID NO: 5523 - protein, 292 aa, Mycobacterium paratuberculosis
MSEPVAPRVAVYLDFDNIVISRYDQIHGRNSFQRDKAKGLEQFTERLEQATVDVGAILDFASSFGTLVLTRAYADWSAEINAGYRGQLVARAVDLVQLFPAAAYGKNGADIRLAVDAVEDMFRLPDLTHVVIVAGDSDYIPLAQRCKRLGRYVVGIGVAGASSRALAAACDEFVIYDALPGVTALDRTPAPAETVPAKPRTRRGKAAQPEEPDPQAAATALLTRALQIGFEKDDVDWLHNSAVKAQMKRMDPSFSEKSLGFRSFSDFLRSRSDVVELDETSTTRMVRLRPHE

SEQ ID NO: 5524 - protein, 697 aa, Mycobacterium paratuberculosis
VIGSDPGLLRLRMATRTTAALGLSLLALWLLTRATGQPLTVALLGVVITMVASRSVNEPDPRQQRITMALLPVPAAVAITAAAVLAPHPVAGDVVFVLIVFAAAYIRRFGARGRALGTVCTYVMTSHVLPDRPERVLRATIRALRARMAIVIDTTAEAVRTGRLDERRRRRMRARTIRLNETALMVQSQIEDRADPGTLWPGVTAEQLAPWLLDAELAIEWVATAGRRAAALGAELPEAARAELVSALTQLGRAIRLPEPGGLRDAASRARRLLDAATDDRPAGTAVRRLALAIINAATATADVRAIVDGAAGAAVPDVAGSERPPAAAGAAAEEPAEQEEEQPAGLRPTTRQAIQVSVAASLAIITGELVSPARWYWAVIAAFVIFAGTNSWGETLTKGWQRLLGTMLGVPAGVLVATLLTGHEAAALAGIFVCLFCAFYFMTVTYSLMTFWITTMLALLYGLLGQFSFGVLMLRIEETALGAVIGATVAVVVLPTNTRTAIRADTRAFLTSLSALIEACAAAMSGSAASPSEQARQLDRDLQQFRVTAKPLLAGVAGLAGRRGIRRALRIFTACDRYGRALARSSEQYRGSPGPGPQLAQAFSAAAAQTRRNLDALLEAIDSGHPPTLVSAADELDAAETAARQHDSDGDGETRPDVRRFLTAVHALRQIERAVISTATNLGGHEDVRTTTAAPR

SEQ ID NO: 5525 - protein, 365 aa, Mycobacterium paratuberculosis
MGPTRAKLADGRDLLFFSLPGHRASPVEDRRPLPPRTAETVAPGGQSQLRFDRSTGQWVIIAALRQDRTYKPPPDACPLCPGPTGLTSEVPAADYDVVVFENRFPSLSGAAPGLLAAGADGFVSAPAHGRCEVVCFSADHTGSFAGLPPAHARLVVQAWRHRTAELMDTPGIEQVFCFENRGEEIGVTLTHPHGQIYGYPYLTPRTAAMLGQADEHRKRHGGNLFGDLLAREVADGSRIIARDDLFTAFVPFAARWPVEVHIYPNRFVPNLTALRDDEVDGFVAVYLDVLRRFDRMYDAPLPYISALHQYTGTGAQAQGYFHVELMSIRRSATKLKFLAASESAMDAFISDVTPESVAQRLRELR

SEQ ID NO: 5526 - protein, 363 aa, Mycobacterium paratuberculosis
MTVRYAAPGRINLIGEHTDYNLGFALPIALPQRTVASFTRADDDAITVVSDRADAPVRIPIDTGPGDVTGWAAYPAGVMWALRTAGHPVPGGVMSITSDVPMGSGLSSSAALECAVLGAISSAAGIRIDATEQARLAQRAENEYVGAPTGLLDQLAALYGRPATAVLIDFADLAVTPVAFDPDAAGVALLLIDSRERHTHAGGDYAARRLSCERAAADLSASSLREAADRGCTDLAAVRDAVDARRARHVLTENRRVIDCVAALNNSDYPEAGRIFTASHASMRDDFGITTERIDLIADTALRAGALGARMTGGGFGGCVIALAPVQRAEAIGHAVRRAATQAGFAQPVVTRTRAAAGAGPCR

SEQ ID NO: 5527 - protein, 200 aa, Mycobacterium paratuberculosis
VPVSEPAGYVEVRAYAELNDFLPAESRGAAVRRPFRAHQTVKDVLEAMGIPHTEVDLIVVNGSVHGFDHRPRAGDRIAAYPMFEALDIGPTARLRPVPLRDPRFVVDVNLGRLAWLLRLFGFDVWWSNDADDQTLAAISAEQHRILLTRDRGLLKRRAVTHGLFVRPDDPEEQALGVIRRLDLTGRLAPLSRCVRCNAGP

SEQ ID NO: 5528 - protein, 207 aa, Mycobacterium paratuberculosis
VGWFRFYFEGERWVWSDQVQRMHGYQPGTVTPTTELVLSHKHPADRPQVIDGINDMIRRRQAFSTRHRIVDTAGIIHHVVVVGDQLFDDSGELVGTHGFYIEVTPAATRNREDSISAKVSEIAGRRGVIDRTKGMLMLVYGIDEDAAFNMLKSLSQHGNIKLSVLAQRIAEDFTALGKEVITARSRFDQRLRTAHLRPPGAGEAGSG

SEQ ID NO: 5529 - protein, 225 aa, Mycobacterium paratuberculosis
MKHLTLATISVALSLALVGCGHDHKSGDKTSSSTSTSTSTSTATSSKSSTAPAAQAKYTIADYVKDNHISETPVHRGDPGPNVDLPVPAGWQLNQNSGTSYGGIVQSQPADPSDPPTVSALFSKLTGDVDPAKIIQYAPGEVQNLPGYSGSGDGSASTLGGYQAWQLGGTYQRGGKTRVIAQKTVVIPSQGAVYVLQLNADGLESDQGPLMDATHIIDEQTTITG

SEQ ID NO: 5530 - protein, 878 aa, Mycobacterium paratuberculosis
MRSRMAPIALVATLAVVMTVIAPAPPRGYDGPPLFVANPVDHVVTLIGTGTGGETVGEINNFPGATVPFGMVQYSPDTAGNYAGYNYDNPRATGFSMTHASVGCAAFGDISMLPVTGGLGVQPWNATERIAHDDTERGVPGYYTVRLPGAGVTAELTATAHTGVGRFSYPGDGRPALLQVRSGSSLAGNSRATIQLGEDNTTITGWATSGGFCDKPNAYTVYFAMKFSRPFISYGSWDGSTVYPGARSANAPYSGGYVEFPAGSVLEARTAISYVGIEGARANLAAEGNAGFDDVRAAAARQWNAALSRVTVAGRNTDDLTTFYTALYRTMLHPNMFNDADGRYVGFDGGIHRVADGHVQYANFSDWDTYRCLAALQALLFPDRAADMAQSLVTDAQQSGALPRWAFANAATGEMSGDSVVPLIVNLNTFGANDFDTAAALRYMVDGATKGGVGLAGYVERRGIATYLRLGYAPFTLEFGRNGWIADASITLEWSIDDFAISRFADSLGDAATAAEFANRAQYWQNLFNASTRSVVPRSWSGFFRPGPAVVVSPDNFGQVGYDEGNAEQYVWSVPHNVAGLVTALGGRAAVAERLDRFTKKLNVGPNQPYLWAGNEPSFGVPWLYNYIGQPWKTQHTVDRVRGLFGPTADGEPGNDDLGALAGWYVWAALGLYPATPGTPILTVAAPLFDRIEIALPAGKSIRIAAPGASGPHHPAYISGLKVDGRPTEHTWLPESIIRTGGTLAFSLAAYPDKHWGTAESDAPPSFGAGSSAVAVNVPQPVVSIAPGHRGSVTLDAQRMIDGAGAYTVSGAASDPGVAVTPTSGQFDAGGAASVSVPITVAPTVPQDYYLVSLTTTVGQSTRTTTVLVDTQAEPESR

SEQ ID NO: 5531 - protein, 791 aa, Mycobacterium paratuberculosis
MRVDGRDIIVSGSLLQPLTRRTNDILRLGMALIFLAVVITGSVITRPQWIALEKSVSQIVGVLSPTQSDVVYLVYGLAIVALPFMILIGLIAAGQWKLLGAYAAAGLSAIVLLSISGTGLAAPRWHFDVLDRLTTLPAQLLDDPRWIGMLAAVLTVSGPWLPARWRRWWWALLLAFVPIHLVVSAIVPARSLVGLAVGWVVGALVVLVVGTPALEVPLDAAVRALAKAGFEVCRLTVVRPAGRGPLILSADGQDADHTALIELYGPHQRSGGALRQLWGKLKLRDAETAPLLTSMRRAVEHRALMAIAIGEAGLANTATVAVATLDRGWMLYSHKPPRGTPIDRCAKTTPVQRLWEALRVLNDHQIAHGDLRAHHITVDDGAVLFGGFGSAEYGATEAQLQSDIAQLLVTTSAHYDPKSAVRAAIDVFGADTILSASRRLTKVAVPKSVRRSAPDSGAVISGARAEVKRQTGADQIKPQTITRFTRSQIIQLVLFGALVYVAYPFISTAPTFFSQLRTADWWWALLGLLVSALTYVGAAAALWACADGMVNFWMLSIAQVANTFAATTTPAGVGGLALSTRFLQKSGLSAMRATAAVALQQSVQVIAHLALLVLFSAAAGASMNLSHFVPSATMLYLIAGVALGIVGTFLFVPTLRRWLATEVRPKLDEVVSDLAKLAREPRRLALILLGCAGTTLGAALALWASIQAFGGDTTFVAVTVVTMVGGTLASAAPTPGGVGAVEAALIGGLAAFGVPAAIGVPAVLLYRMLTCWLPVFVGWPVMRWLTKHEMV

SEQ ID NO: 5532 - protein, 320 aa, Mycobacterium paratuberculosis
VPRTDDDSWEITESVGATALGVAAARAAETESENPLISDPFARVFLDAAGDGMWNWFAAPNLPAQIAEAEPDLKPRMQGMVDYMAARTAFFDNFFLAATHAGVRQVVILAAGLDSRAWRLPFEDGTTVYELDQPRVLEFKATTLAEHGARPTCHLVSVPVDLRHDWPAALRQAGFDAHAPSAWSAEGLLPFLPAAAQQLLFERVQTLAAPGSRIAVEAPGPDFIDEAARERQRQTMQRVRDLMADLEPDRDIPDVQDLWYFEEREDVGDWLGRHGWDVTVTPAPELMARYDRRPPHDIEDAIPQTRFVAAQRTERTRPDR

SEQ ID NO: 5533 - protein, 177 aa, Mycobacterium paratuberculosis
MSTARSDDDSWEITESVGATALGVASARAAETRSENPLIKDPFRTGLPGRRRRRRVELALRAAAAARADRGRTDHTAAAAGHGRLYGFAHSVFRLVLPGGNRCGHPSGGDPGGRAGRAVLAAALAGRDHGLRARPAPGAGIQGVHPGRTRGAARLQPGRRAGGSAPRLAGSVAAGRV

SEQ ID NO: 5534 - protein, 485 aa, Mycobacterium paratuberculosis
VWNWHSAPQLPPELIEAEPTIPLQQQAMVGYMASRTAFFDSFFLEATGAGIRQAVILAAGLDARSWRLPWPAGTTVYELDQPRVLEFKESTLAEHGAQPACNRVAVPVDLRHDWPEALRQAGFDASAPSVWSAEGLMPYLPAAAQDLLFDRIQGLTVAGSRVAVEALGPKFLDPQARAKRRERMDRIQALMARIDPDRAVPRTDELWYFEEREDVGEWFGRHGWDVRVTPSDELMAGYGRGRRRPRSATSCRGTCSSPRSGGRPEGLAFRQGESRARRHRRDVAGQHGFGNQCGGPDCGSAQHRRAQVDHPAQQRGFSDDAPDAAPAERGEPGERGGQVVRLVDARGQHRGVLEPLATALTQVRAHRMSRVADHHDGPARPGPGGGAVVKVVAQHLVAGRRCQHPRNRFGPIGESCLQIGQFAARRELPFRSALGGEPIQAIRTHRHMAGFDAGTKCLAGQLGVHRRSPHRAMRCSRRTGRRAGR

SEQ ID NO: 5535 - protein, 179 aa, Mycobacterium paratuberculosis
MAQRILVIGAGIAGLATAVAMQRRGYAVTVVEERTDTSSGAGISIWPNALAALDRIGVGQAVRDAGGRITAGALRWRDGSWLRRPAPERLIKALGEPLVIVQRSALRDILTGALAPETIEYGLSAIKLTRAADGVRVRLSDGNDRTTDAVIGADGTRSVVARHLNGPLADRYVGYTAWR

SEQ ID NO: 5536 - protein, 87 aa, Mycobacterium paratuberculosis
MVSVVGKNTSFSLDEHYSAFIESEVASGRYRSASDVVRSALRLLEDRETQLRALREALEAGERSGTSTPFDFDTFLDRKRTEASDGR

SEQ ID NO: 5537 - protein, 236 aa, Mycobacterium paratuberculosis
MALQPVIRRSVPEAVFDQIATDVLSGELPAGSALPSERRLAEVFGVSRPAVREALKRLSAASLVEVRQGGVTTVRDFRRHAGLDLLPQLVFRDGELDAGVFRSILETRLRIGPKVAELAAEQHGPELAALLDDSLRRLEASRSAVEWHRGTLEFWDHMVDSSGSIVFRLMYNPFRAAYERAVGVLAAAIPAEINRTDAYRALAQAICAGDADEAGRGAREVLELANATMIGALERR

SEQ ID NO: 5538 - protein, 265 aa, Mycobacterium paratuberculosis
MSSQAVIANYLRGQIQPGIDAVGGFFRTCVLTGKALFRRPFQWRETIEQGWFITSVSLLPTLAVAIPLTVLIIFTLNILLAEFGAADISGAGAALGAVTQLGPLTTVLVIAGAGSTAICADLGARTIREEIDALEVLGIDPIHRLVVPRVVAATIVATLLNGAVITIGLVGGFVFGVFIQHISAGAYVGTLTLITGLPEVVISVVKSATFGTIAGLVGCYRGLTTKGGPKGVGTAVNETLVLCVIALFAVNVVLTTIGVRFGTGR

SEQ ID NO: 5539 - protein, 292 aa, Mycobacterium paratuberculosis
MAAISAPGALRARYPRTAANLDRYGGGTVRRLWQIGIFARFARISIGQTGWALRHYRRETLRLVAEIGMGTGAMAVVGGTVAIIGFVTLSGGSLIAIQGFASLGNIGVEAFTGFFAALANTRIAAPIVAGVTLAATVGAGATAQLGAMRISEEIDALEVMGIKSISFLVSTRILGGLAVIVPLYALALDMAFTSGQVVTTVFYGQSNGTYEHYFRTFLRPEDVGWSVFEVVIIAVVVMITHCYYGYTASGGPVGVGHAVGRSMRFSLVSVVVVVLLAQLALYGVDPNFNLTV

SEQ ID NO: 5540 - protein, 407 aa, Mycobacterium paratuberculosis
VSAMATPVPQRGRRAWVYVEGVFLLLVCALVLALVYLQFRGDFTPKTKLTMVATRAGLVMETGSKVTYNGVAIGRVADISEIERDGAPAAKLVLDVDPRYVNLIPANVVATIEAATLFGNKYVSLSAPENPSRQRISPRDVIDARSVTTEFNTLFETVTSIAEKVSPIELNATLSALAQALDGLGGKFGESIVNGNQILAQLNPRMPQIRYDVRRLADLAGAYTKAAPDLLDFLSNAVTTARTLTRQQGDLDAALLAAVGVGHEGEDIFARGGPYLARGAADLVPTAELLDTYSPELFCMIRNFHDAAPEVAKAAGGNGYSLAAAGSIVGAPNPYVYPDNLPRVNAHGGPGGRPGCWQKITRDLWPAPYLVMDTGASLAPYNHLEIGQPLATEFVWGRQYGENTINP

SEQ ID NO: 5541 - protein, 343 aa, Mycobacterium paratuberculosis
MRITGTAVKLVVFWSVLAMFTVMIIVVFGQVRFDRTTGYSAVFTDAGGLRAGQFVRASGVEVGKVAAVTLSDKDSRVLVEFNVDRSLALDQGTTASIRYLNLIGDRYLELKRGTSGRRLPPGGRIPVEHTQPALDLDALIGGFRPLFQALDPNKVNSIAQSIITVFQGQGATITDILDQTAALTAALADRDKAIGEVINNLNTVLATTVKHEKEFDRTVDKLELLITGLKNRADPLAAAAAHISDAAATVAGLLGEDRPSLHGTLGHLEGIQQALINDLPTVDNVLEKLPGAFRVIGRAGGIYGDFYNFYLCDISIKVNGLQPGGPVRTIKLFGQPTGRCTPQ

SEQ ID NO: 5542 - protein, 484 aa, Mycobacterium paratuberculosis
VHAAMRTLTEFNRTRVGLMGALVTVLVVGVGQSFTSVPMLFATPTYYAQFTDAGGINVGDKVQIAGVNVGLVSSLVIRGDRVLVGFSMPGKTIGAQSRSAIRTDTFLGRKNMAIQPRGADPLPPHGIIPSGQTTTPYQIYDAFVDVTKAATDWNIDVVKRSLNVLSETFNQTAPHLKAALDGVARFSGTIGNRDEQIKQLLTNADKITRVLGDRSGQVDALLVNANTLLAAFRQRSQALSALLSNVSAVSTQVSGFIKENPDAHQVLRQLGTVSDELVKRKKELSDVLVLVSRYTASLTEAVASGPFFKAIVANLLPYQVLQPWVDAAFKKRGIDPENFWRSAGLPAFRWPDPNGTRLPNGAPPPAPPVAEGTPDHPGPAVPPGSPCSYTPAADSPPRPGNPLPCALSGQGPFGPVPDGFPAPLDVETSPPAPDGPPPSPGVPSAGRPGEAPPDVPGTPVPLPVHAPPGARTENPPDATGGSTR

SEQ ID NO: 5543 - protein, 499 aa, Mycobacterium paratuberculosis
MSTIFDIRNLRLPKVSARVLVIAALAAVFVFIAAVAGVQLYRKLTTTTVVAYFSETLALYPGDRVQIMGVRVGSIDKIEPAGDKMRVTLHYNNKYRVPANATASILNPSLVASRTIQLSPPYTGGPVLRDGAVIPIERTRVPVEWDQLRDSINAILRQLGPTPQQPVGPFGDIIESAADNLSGKGKQVNETLNSLSQALTALNEGRGDFVAITKSLARFVTALYQHKQQFVALNDNLAQFTDWFTQSDHQVSDTIAHLDQVLDAARKFVNDNGSALTHDVGNLADVTTTILQPEPRDGLETALHVLPTFAGNFNNLYQPAHSSLVGLFVFPNFANPIHFLCSAIQAGSRLGYQDSAELCAQYLAPVLDAIKFNYPPAGLNPFNSAATLPKEVAYSEERLRPPPGYKDTTVPGIFARDTPFSHGNHEPGWVVAPGMQGTDVQPFTAGMLTPESLAELMGGPDAAPPPPGVTAAGPPNAYDESNPPSPPWFSRPTPPGPGR

SEQ ID NO: 5544 - protein, 379 aa, Mycobacterium paratuberculosis
MRRVAVAGRRALVVALAAMLTSCTWRGIADVPLPVGRGTGGDHMTIYVQMPDTLALNTNSRVRVADVWVGTVRAITLKDWVATLRLDLDPGVRLPANATAKIGQTSLLGTQHVELAAPKNPSAQRLKSGDTLLLQNSSAYPTVERTLASVAVILNGGGIANLDAIQTEVLNILDGHAGQIREFLGRLDTFITELSSQRDDLTRAIDSSNELLTVFANRRDTLDRVLTELPPLIRHFADTRELFADATESLGRFSDAADRALTDARANLYRSLLSLQRPLRQLVPAAPFVAGALKLGLTAPFNIDDVAQVIRGDYVNVSAALDLTLSTIDNTMLTGTGLSGALRALEQSWGRDPATMIPDVRYTPNPNDAPGGPLVERGE

SEQ ID NO: 5545 - protein, 512 aa, Mycobacterium paratuberculosis
MLPRMIKTQLVLLTAVAVAAVVVLGWYYLRIPSLAGIGRYTLYAELPQSGGLYRTANVTYRGITIGKVTGVEPTERGARATMSIEDGYRIPADAAAHVHSVSAVGEQYVDLVSTAGREPYLADGQTIHKSTVPSQIGPALDAANRGLAVLPRDKIASLLYETSQAVGGLGPSLRRLVDATQAIAHDFRGSIDDVDDIVERSAPIIDSQADSADTLGRWAANLNTLAAQTARQDPALRSILTNAAPTAEQVRATFGGVRESLPQTLASLEVVIDMLKRYHNGVEQALVFLPQSGAIAQSVTAQSPGQAALGVGAISLNQPPPCLTGFLPASQWRAPADTSTAPLPAGTYCKIPMDATNVVRGARNYPCVDVPGKRAATPRECRSTEPYVPQGTNPWYGDPDQILTCPAPSARCDQPVKPGLVIPAPSVDNGLNPLPADRLPGTPPPISDPLQRPGSGTVVCNGQQPNPCTYTPSALYDVRSGTVVGPDGVVYSVANSATIGDEGWKTMLGQAR

SEQ ID NO: 5546 - protein, 233 aa, Mycobacterium paratuberculosis
MDDQEAPDAPASRRAHILRLAVFAGFLAVVFYLVAVARVIDVGAIRAVVSATGPAAPLTYVVASALAGALFVPGSILAAGSGLLFGPLLGVFVTLGATVGTATTASFVGRRAGRDSARALLGPARADRVDALIGRGGLWAVVGQRFVPGISDALASYAFGAFGVPLWQMAVGAFIGSAPRAFAYTALGASIGNRSSLLAYAAVAVWCVSAIVGAFAAHRGYRHWRGRPKDEAR

SEQ ID NO: 5547 - protein, 281 aa, Mycobacterium paratuberculosis
SWSAIPTSWASVEAGAVLADLVDGLAGRAGVRVAALATPHRFGSAIGALAAAIRAGDADRVLELLAAGGEHIEWVDSERPADRLREVLVSHALRLRSAALLGAAQAALATLDEHRLLCAHRDGPHGAVRWNTLVHNWIAEETGQPAWSQWYAGRPLLVTANDYGLRLYNGDTGVTVAGADGLRAVIAGAAGPLDFATSRLGEVETMHAMTIHKSQGSQADEVTVLIPPEDSRLLTRELFYTAVTRAKSRVRVVGPEASVRAAIERRAIRATGLRQRLRAVG

SEQ ID NO: 5548 - protein, 362 aa, Mycobacterium paratuberculosis
VTADVLPERVFDAGPLRPFADAGIFEAADVRVAQRLTALTGESDDRVALAVALLVRALRGGSVCVDLRAVPAQVGAADLPWPAAGDWLAAVRASPLLGPPPVLRFFGDLLYFDRYWLEEEQVCTDLLALSAPAGDVESSCYERLFPPGYEEQRAAARIAVSQALTVLTGGPGTGKTTTVARLLALLVEQAERAGEPRPRIALAAPTGKAAARLAEAVAAEIEHLDPADRARLAGLTGTTLHRLLGPRPDTSVRFKHNRGNRLPHDIIVVDETSMVSLTMMARLAEAVRPDTRLILVGDPDQLGLGGGGRRAGRSGRRAGRPRRGAGRRAGHPAPVRQRDRRAGRGDPGRRRRPGAGVVGGRR

SEQ ID NO: 5549 - protein, 619 aa, Mycobacterium paratuberculosis
VVRAAAATMFFGETAETLAAGGDALTDRIAQTLREWAGHSRERGVAAIFEAAQLLGMSNRVLGWQGGARHMTDLAHLTQLLGEVAHREHHNLPALRDWLRRQRDERSGAPERNRRLDSDAAAVQIMTVFVSKGLQYPIVYLPFAFHRNTTDSDVVLFHDEDGTRCLHVGGKDSPDFKTVERLGRKEDASDDSRLTYVALTRAQAQVVAWWSPAYHEPNGGLSRLLRGRRPGEPVVPDRCEPAKISDADALARLREWEAAGGPVIEESVPAPAPPLSGVPVPARLENRHFHRGIDTGWRRTSYSGLIRQAQPSGVGSEPEAAGLDDEVGDILLAPATSVGDVASPMADLPAGATFGTLVHAVLQTADPFAPDLAAELTARIREHSVWWPVAATPEDMAAAMVPMHDTPLGPLAGGLTLRRIGLSDRLCELDFELPLAGGDRRSAPPEVRLADLSPLLRAHLPADDVLACYADRLTDRSLGAEPLRGYLTGSIDAVLRIPDGAGHRYLVVDYKTNRLGDAQHPLTAADYDRPRMVEAMLHSDYPLQALLYSAVLHRFLRWRLAGYEPDRHLGGILYLFVRGMCGPDTPVRDGHPSGVFDWRPPSSLITALSDLLDAQGVAV

SEQ ID NO: 5550 - protein, 378 aa, Mycobacterium paratuberculosis
VAYLLDGTEDRLAARRQRLRDALAGFDAATIATTHQFCQLVLRSLGVAGDTAAGVTLLDSLDELVAEIVDDLYLAHFGQDHDDPVLHYREALRLARDVVNNPSAQLRPLHPEPGSRAAVSLRFANDVLAELDTRKRRLGVLGYDDLLTRLADALATEHSPARLRMHQRWPIVMVDEFQDTDPVQWQVIDRAFSGRSTLILIGDPKQAIYAFRGGDIVTYLRAAETAGQKKTLDTNWRSDSALLQRLQVVLRGAQLGDPAIAVNDVAAHHRGHRLSGAPRNDPFRLRVVSRNTLGRRGIANLPIDELRQHIGADLAADIRALLAAGATFDGKPLRAGDIAVIVERHRDAQACFTALCDAGVPAVYTGNSDVFTSQAAED

SEQ ID NO: 5551 - protein, 1096 aa, Mycobacterium paratuberculosis
MPLHLHRAERTDLLADGLGALLANPPADPFALELVVVPARGVERWLSQRLSHVLGRARDGDGVCAGVQFRSPGSLIAEITGTADDDPWSPDALAWPLLEAIDCSLDEPWCRTLATHLGHFDTGAEAELRRTRRYEAARRLAGLFAGYARQRPRLLVDWLDGDPGDLDEDLRWQPPLWRALLARVAADPPHVRHAETIARLRRAPSDLPQRLSLFGHTRLACTDVELLDALATHHDLHLWLPHPSDRLWRALAGTHGVIPRRDDTSHRAVAHPLLATLGRDLRELQRGLPADPRTDEYLAGDARPDTLLGWLQSDIAANAVRPVGRSLAAGDRSVQIHNCHGPARQVDVLREMLLGLLADDPTLQPRDILVMCPDIESYAPLIMADFGLGDVVHGAHPAHQLRVRLADRSLIQTNPLLGVAAQLLALAGGRVRASEVLNLAQTPAVRARFGFTDDDLDTITGWVRQANIRWGLDRQHRRPYHVDFVHNTWRFGIDRILAGVAMSDDSNAWIDATLPLDDVSSNRVQLAGQLAEFVARLQHVLDSLTGARPLTDWLTAVADGIALLTRVRDADEWQSGQLQREFAAVSAQAGSRADTVLRLPDVRALLTRHLSGRPTRANFRTGTLTVCTMVPMRSVPHRVVCLVGLDDGLFPRLGVVDGDDALARCPMTGERDIRSEDRQLLLDAIGAATEKLVITYTGANEYSGQPRPPAVPLAELLDTLDITTAEPVRDRIVVRHPLQPFDIRNIIPGELVPGVPFSFDPTVLRAAHAATGEHCEPPKFISAPLPPPPPADVILADLVGFFKDPVQGFFRALQFTLPHDVDGVQDAMPVDIDALQEWTVGDRMLRDMLRGMTPEDARQAEWRRGTLPPGQLGWRRVTEIRDQAARLALEAHQHRAEQPGGAHDVDIDLGRGRRLTGTVTPVYGDRLVAVTYSRLDGRHLLESWIPLLALAAHDRGRDWSAVCIGRMRRGTGIRVQRLGSPDDDPVELLRELVSIYDAGRREPIPLPLKTSYAWAAARYGGDDPVAEARYRWKSSDRYPGEDQAPAHVRAWGRGAPLDDLMRPVRPGEECDGEDNRLGAYAARLWLPMLRAERTTA

SEQ ID NO: 5552 - protein, 288 aa, Mycobacterium paratuberculosis
VAENLTPHFEEVQAHYDLSDDFFRLFLDPTMTYSCAYWDRNRDISLEEAQLRKIDLSLGKLGLRPGMTLLDVGCGWGATMRRAVENYDVNVIGLTLSRHQAAHVQQLLDAMDTPRSRRVLLHGWEEFDEPVDRIVSIGAFEHFGYDRYDDFFATAYRVLPDDGVMLLHTITMLTPEQIVERGLPLTEEQTSFNEFIATEIFPGGQLPAIEVVEFHSSKMGFTLKRRQSLQLHYARTLDHWADALRAHHSEAVAIQSEEVYQRYMRYLTGCADAFRAGYIDVNQFTLAK

SEQ ID NO: 5553 - protein, 171 aa, Mycobacterium paratuberculosis
MEAWDAICARRNVREYQPRAIAGEDLDRIVEAGWRAPSAKNRQPWDFVIVTDRTQLQELSTVWRGAGHIAGAPAAIAIVVPEPPDERRVVTDNYDVGQATMAMMIAATDLGIGTGHSSVGDQDKARAILGVPDGHLVAFLLGVGYPADRPLTPIRKPNRRPFTEVVHRGRW

SEQ ID NO: 5554 - protein, 257 aa, Mycobacterium paratuberculosis
LSSRKLIGVHDHRGEYGVDGSFHTVSARAQAIGIGAQAAGLAVWAGISWARGKRRRAALAALSSAGIAANTALYMYATRAGKFVVWDRILSDLRLAGDETLLDLGCGRGAVLLAAAKRLPRGRAIGVDLWQADQTDNSEQATLANAAAEGVADRVELHTADMTALPLADESVDVVVSNLAIHNIPTRAGRRQALDEAVRVLRPGGRLAIADLWETRQHAARLRELCWRNVRRRNLGWRMWYGGPWFSTRIVTATKPE

SEQ ID NO: 5555 - protein, 171 aa, Mycobacterium paratuberculosis
VARPWNGLWLPPDAACMLGRMTRNQLTEQIVVARLAKGLTWQELADAIGRPLLWTTSALLGQHPIPAELGRILVDKLGLDESAVPVLAAPPMRGGLPTAVPTDPTIYRFYEALQVYGGALKEVIAEQFGDGIMSAINFSVDLQKKPHPSGDRVVVTFDGKFLPYQWVSSEQ

SEQ ID NO: 5556 - protein, 339 aa, Mycobacterium paratuberculosis
VTSKTEPAKPVDLVLSGGVKFIGLVGAIVALMDAGYSIKRVSGVSAGSVVAAILAAGCHAGELTGAQVKELAFSVPLHKWRDAGPVPYLGAAWGLARDTSMYRGDVAHDWIRSELKNFGVSTFGDLVFDGDDLPDERRRRLVVTVADVTAAQLVRLPWDYRRLYGLDPDEQPVADAVRASMAIPFFYRPVKLARADGTACTLVDGGVLSNFPIDTFDRPDGRAPRWPTFGITVMPSPTEGIGAVMPALKPLRFLPQTALLESLLITMLAGHDQTHLSQPWVAARAIAVESTNVGVLDFDVPRSRLEELYDSGYAAAQAFLSTWDWQGYLDRFRYPGGRG

SEQ ID NO: 5557 - protein, 159 aa, Mycobacterium paratuberculosis
MKLRLAIRELHRSERKLAHQLTVLAARHHSDQDIFHLARDLAGWSHRHLGELARHGRHYGLRLSADPRTAARTGVVQQRISGLLRHRPEPGLVLLADLRRIHRLAAGVSLDWELLAQGAQAAKDAELLGLASRCHPETLRQMRWANAMLKELSPQVLMN

SEQ ID NO: 5558 - protein, 750 aa, Mycobacterium paratuberculosis
VDRWVQSAAVLHSNGDGLDIAVKDGRIVGVRGRAVDRVNHGRLDPKDLFGWQANASADRLTTPLLRVRGALRPCDWDTAMERIVARSRELLERHGPSSIGFYTSGQLFAEEYYTQAAIAHGAIGTNHVDGNTRLCTATAAEALKESFGCDGQPGSYTDVDHADVIALFGHNVAETQTVLWARMLDRLAGSDPPAIVCVDPRLTPVARHATVHLAPLPGTNVALMNGLLHEIIGNGWIDRDYIDAHTVGIDELQCRIGEFTPERVAEICGVAATDLRRAARLIGTARRLLSTVLQGFYQSHQASAAAVQVNNIHLVRGMLGRPGCGVLQMNGQPTAENTRECGADGDLAGFRNWSNDSHVAELAELWNLEPLQIPHYGPPTHAMQMFRFTEEGTLRMLWVTATNPAVSLPELPRIRDILSQQRLFLVVQDIFLTETAALADVVLPAAAWAEKTGTFTNADRTVHLSEKAVEPPGSARSDLEIFLDYARRMDFRDKDGRPFPPWTDPESAFEAWKKCSAGRPCDYTGLSYAKLRGGSGIQWPCNTDHPDGTERLYEDGRFPAAPDYCEAYGKDLITGAPLQPDEYRSLNPSGKAIIKAAQYLPPHERPGPDYPFALITGRTVYHFHTRTKTARAQQLQDAAPEVWVEVSERDARRLDIEAGDLVHVSTPRGRITCAARVGGIRDGVLFVPFHYGYWDRDGGDHQRAGNELTATDWDPASKQPSFKTAAARLDKAPSHRAAPVSEAVAAGSPS

SEQ ID NO: 5559 - protein, 258 aa, Mycobacterium paratuberculosis
MSACAGATPKTTWASTTASRRDGKEQLMSGPVHYSAKGPVAVIRMDDGKVNALGPTMQQALGEAIDRAEADNAGALVITGNERVFSGGFDLKILTSGEVQPAVDMLRGGFELAYRLLSYPKPVVMACTGHAIAMGAFLLSSGDHRVAAHAYNIQANEVAIGMVIPYAAMEIMKLRLTPSAYQQASGLAKTFFGETALAAGFVDEIVLPEVVVDRAEEAAAEFAELNQRAHAATKLRARADALAAIRAGIDGIEAEFGL

SEQ ID NO: 5560 - protein, 280 aa, Mycobacterium paratuberculosis
VDSMGWIQDSWHGVTHVGSSTWIAWAAWAAIALAVITLIFTNSQIARNRRAAAEQTRPHVAMFMEPHPADWHVIELVVRNFGQTAAYDIEFSFDNPPTVAEYESATDGYADVVELRLPRQLPVLAPGQEWRTVWDSALDRAEIGSGIESRFTGTVTYYDRPAPAGGRRFWQRERTPLHTDVVLDWDALPPVQRIELMTTHDLAKREKEKLELLRGLLTYFHYASKETRPEVFRSEIERINAAVRETQDRWRSRQLDEPTDVSLRWSNAEDDLGKHHSQPA

SEQ ID NO: 5561 - protein, 237 aa, Mycobacterium paratuberculosis
VSDDRLYFRQLLSGRDFAAGDMFATQMRNFAYLIGDRQTGDCVVVDPAYAASDLLDTLEADGMHLSGVLVTHHHPDHVGGSMMGFTLAGLAELLERAPVPVHVNSHEALWVSRVTGISASDLTAHENHDKVSAGDIEIELLHTPGHTPGSQCFLLDGRLVAGDTLFLEGCGRTDFPGGDSDEMYRSLQRLAKLPGDPTVFPGHWYSAEPSASLSEVKRSNYVYRASDLDQWRMLMGG

SEQ ID NO: 5562 - protein, 76 aa, Mycobacterium paratuberculosis
VVSGYCCRMRKKVEIEVDLELVDEAIRRFHLADAREAVNLALRTLLHEGDSVASEDEYDEFSDLSAWQPRRNAESG

SEQ ID NO: 5563 - protein, 55 aa, Mycobacterium paratuberculosis
MASSTDVRPKITLACEVCKHRNYITKKNRRNDPDRLELKKYCPNCGKHQAHRETR

SEQ ID NO: 5564 - protein, 159 aa, Mycobacterium paratuberculosis
VPLTTNLVGMHYRYPDHYEVEREKIREYAVAVQNDDAWYFEEKAASELGYKGLLAPLTFVCVFGYMAQSSFFKHANIAVKDAQIVQVDQVLKFYAPLVAGDKLYCDVYVDSVRVSHGTQIIVTKNVITNEAGDVVQETYTTLAGRAGEDGEEGFTDATA

SEQ ID NO: 5565 - protein, 142 aa, Mycobacterium paratuberculosis
MPLREFSSVKVGDLLPEKVYPLTRQDLVNYAGVSGDLNPIHWDDEMAKVVGLDTAIAHGMLTMGIGGGYVTAWIGDPGAVTEYNVRFTAVVPVPNDGKGAELVFNGRVKSADPETKSVTIALTATTGGKKIFGRAIASAILA

SEQ ID NO: 5566 - protein, 167 aa, Mycobacterium paratuberculosis
MALKTDIRGMIWRYPDYFVVGREQLRQFALSVKNRHPAHFSEDAAAELGHDAIIAPLTFATIFAKLVQLDFFRHVDIGMETLVIVQVDQRFVFSKPIKAGDKLWARMDIVSVDERFGADIVVTKNICTNDDGELVLEAYTTLMSQFNGDQSAKLRWDSESGQVVRTA

SEQ ID NO: 5567 - protein, 147 aa, Mycobacterium paratuberculosis
VSDEGDVANDAASDGADTTDDRAGGGRTAVVTRPQRPTGKRSRQRAAGDADAEPSDEAEVSAPEKAEKAKRKKAAKPKKSADTRANPFVFVYNYLKQVVAEMRKVIWPNRKQMLTYTSVVLAFLAFMVALVGLADFGLTKLVLLVFG

SEQ ID NO: 5568 - protein, 256 aa, Mycobacterium paratuberculosis
VTTFDGDPSAGDAVDLRETDEATEAADEAAETTEDAAESAETQGEPAEEVDPAAALKAELRSKPGDWYVIHSYAGYENKVKANLETRVQNLDVGDYIFQVEVPTEEVTEIKNGQRKQVNRKVLPGYILVRMDLTDDSWAAVRNTPGVTGFVGATSRPSALSLDDVVKFLLPRGATKKVAKGAASTAAAAEAGGLERPAIEVDYEVGESVTVMDGPFATLPATISEVNGEQQKLKVLVSIFGRETPVELTFSQVSKL

SEQ ID NO: 5569 - protein, 142 aa, Mycobacterium paratuberculosis
MAPKKKVVGLIKLQIQAGQANPAPPVGPALGQHGVNIMEFCKAYNAATENQRGQVIPVEITVYEDRSFTFALKTPPAAKLLLKAAGVGKGSAEPHKNKVAKVSWDQVKEIAETKKADLNANDIDAAAKIIAGTARSMGITVE

SEQ ID NO: 5570 - protein, 235 aa, Mycobacterium paratuberculosis
MSKRSKAYRAAAEKVDRDNLYTPLQAAKLAKETSSTKQDATVEVAIRLGVDPRKADQMVRGTVNLPHGTGKTARVAVFAVGEKAEQAQAAGADIVGSDDLIEKIQGGFLDFDAAIATPDQMAKVGRIARVLGPRGLMPNPKTGTVTPDVAKAVADIKGGKINFRVDKQANLHFVIGKASFDEKALAENYGAALDEVLRLKPSASKGRYLKKITVSTTTGPGIPVDPSITRNFAEA

SEQ ID NO: 5571 - protein, 420 aa, Mycobacterium paratuberculosis
MADLDGVFRREWGPAVAALARWSGDLTVAEDAVQEACAEALRVWPRDGMPANPGGWLVTVARNRARDRLRRESARPGKELAAVLDDIRARTDAADPHPVRDDELRMMFTCAHPALDRPSQLALTLRLVSGLTVAEIARALLQSEAAIGQRITRAKNKVRHANIPLRVPPAELLGERTPHVLGCVYSVFTEGYWSTAGPSAIRDDLCDEGIRLGAELCALLPDEREAHALSALMLLHDSRRATRVDARGVPVPLEEQDRTRWDRRRITAGLDRLRYAEGSSGAYLPQAVIAALHATAPSWEQTDWVTICAAYDRLWQLTRSPVVAANRALAIGLRDGPDAGLAALEEVDEPKLERSNLIATLRADLLRRAGRPAEALPWYRIALQSNGSEPGRKFLRRRIAECTSAAESATGDAFPENGRR

SEQ ID NO: 5572 - protein, 226 aa, Mycobacterium paratuberculosis
LISRERERKPDDAAAAMAAWESFHAKAGPAIKAGDALAPAAAAAVITGGPDAPVVTDGPFAETAEVACGYYIFEAENLDEALALARDVPVAAFGAVELWPVVHAVEPSRRITGNDWLALLLEPAESAHTPGTPEWEAVAAKHAELHAAAGDHIIGGAALHDKSTATTVRVRDGEVLITDGPYVESAEIATGIYLLGAADRDEAVKIASMIPASTVQLRQLAGVSGL

SEQ ID NO: 5573 - protein, 298 aa, Mycobacterium paratuberculosis
MAEQPSSPTKTRTRSEDIQAHYDVSDDFFGLFQDPTRTYSCAYFARDDMSLEEAQYAKIDLNLDKLDLKPGMTLLDIGCGWGTTMKRAVERFDVNVIGLTLSKNQHARCEELLASLDSNRSRQVRLQNWEDFNEPVDRIVSIEAFEHFGHENYDDFFKRTFDIMPDDGRMTVQSSVSYHPYDLAARGKKLSFETARFIKFIVTEIFPGGRLPSTQMMVDHGEKAGFVVPEPLSLRPHYIKTLHIWGDTLESNRDKAIEVTSEEVYNRYIKYLRGCEHYFTEEMLDCSLVTYLKPGAAA

SEQ ID NO: 5574 - protein, 286 aa, Mycobacterium paratuberculosis
MAKLKPYYEESQATYDISDDFFALFLDPNMVYTCAYFENDDMTLEQAQLAKLDLGLDKLNLEPGMTLLDVGCGWGGAVVRALEKYDVNVIGITLSRNHYARTKERLAAIPTTRRAEARLQGWEEFDEPVDQIISFEAFDAFKKERWPAFWDWAYKSLPNDSRMLMHSIFTYPQSQWKERGIPITMSDLRFFHFLGKEIFPGGQMCGEADIVDLSQASGFSLEQVQYLRPHYARTLDTWAANLEANREQAIAIQSQEVYDRFMRYLTGCAELFRKGISNVAQYTLTK

SEQ ID NO: 5575 - protein, 302 aa, Mycobacterium paratuberculosis
MVQVRTGHAISGDLKLYYEDMGDIDDPPVLLIMGLGAQLLLWRTAFCEKLVGRGLRVIRYDNRDVGLSSKTEHRSSGQPLVTRLLRSWLGLPSQSAYRLEDMADDAAAVLDHLGIDDAHIVGASMGGMIAQIFAARFRQRTKTLAVIFSSNNSALLPPPAPRALLALLKGPPPDSPREVIIDNAVRVGRIIGSPRYRVPEEQARAEAAEGYDRNYYPQGVARHFSAVLGSGSLRRYNRRTTAPTVVIHGRADKLMRPFGGRAVARAIDGARLVLFDGMGHDLPQQLWDQVIGVLANNFAKAS

SEQ ID NO: 5576 - protein, 452 aa, Mycobacterium paratuberculosis
MSSTKHREVAKLDRVPLPVEAARVAATGWQVTRSAARVLTKLPAKGPWQQKVIKQLPQTFADLGPTYVKFGQIIASSPGAFGESLSREFRGLLDRVPPADPDEVHKLFLEELGADPSELFASWDETPFASASIAQVHYATLHTGEEVVVKIQRPGIRRRVAADLQILKRFAQAVELAKLGRRLSAQDVVADFSDNLAEELNFRLEAQSMEAWVSHLHASPLGKNIRVPQVYWDFTTDRVLTMERVSGIRIDDVAAVRKAGFDGVELVKALLFSLFEGGLRHGLFHGDLHAGNLYVDEAGRIVFFDFGIMGRIDPRTRWLLRELVYALLVKKDHAAAGKIVVLMGAVGTVKPEAQAAKDLEKFATPLTMQTLGDMSYADIGRQLSALADAYDVKLPRELVLIGKQFLYVERYMKLLAPKWQMMSDPQLTGYFANFMVEVSREHSSEFESDVEV

SEQ ID NO: 5577 - protein, 201 aa, Mycobacterium paratuberculosis
MPALARPVADERSALCEFLAYHQSAYFAVSHGLTDGQARSAPSVSALSIGGLIKHATGMQRSWMARVAAAPGAPPKDTRPFEQVAAEFADQHVMRPDETLQELLDAFEAQNAESLRLAQTADLDAAVPVPHDIPWFPKDLQAWSVRWVILHVINELARHAGHADIIRETIDGATMYELIAAREGWAIEGWVQPWKGGGDRR

SEQ ID NO: 5578 - protein, 1407 aa, Mycobacterium paratuberculosis
VRAVKCGDAGGFGMEITSALSTELFVGPPEAPLQLVRVAVAGCAERTPVRVDGPGLRGRALAEAGAEVIEVAVTVDEPVVGQRRPARAGAGEAELPFEFTVAEPGWTMFMVSHFHYDPVWWNTQGAYTSEWTEDPPGRARQTNGFDLVHAHLEMARREPEYKFVLAEVDYLKPYWDTRPEDRADLRRFIAQGRVEVMGGTYNEPNTNLTSTETTIRNLVHGMGFQRDVLGADPATAWQLDVFGHDPQFPGLAADAGLTSSSWARGPHHQWGPATGDGSDGGVERMQFSSEFEWIAPSGRGLLTHYMPAHYSAGWWMDSAASLAEAQDATYALFVQLKKVALTRNVLLPAGTDYTPPNKWVTAIRRDWAARYTWPRFVCALPREFFAAVRAELAQRGGAPSPQTRDMNPIYTGKDVSYIDTKQANRAAENTVLAAERFAVFAGLLAGAEYPEAALAKAWVQLAYGAHHDAITGSESDQVYLDLLTGWRDAWELGRTVRDDALALLSRRVDGADVAVWNPLNGRRTDVVTARLDAAPGAGVRVLDADGVEVPAHVEHGGRSVSWLARDVPSLGWRAYRLVAGEAASGWAPLRGSAIANEHYRLAVDAERGGTVASLIADGRELIAEGRVGNELAVYEEYPSHPSQGEGPWHLLPKGPVVCSSATRARVRAYRGPLGERVVVHGRIGTLLRYTQTLTLWRGVARVDCRTTIDEFTGADRLVRLRWPCPVPGAMPVSEVGDAVVGRGFALLHDGDRALDTARHPWTLDNPAYGWFGLSSVARVRISDGGLRCLSVAEVVSPAETTSGPLARELLVALVRAGVTATCSAADGPRYGHLEVDSNLPDVRVALGGPRRNAFTAAVLADADPAYADELRRQLAATGRARLWVPARAPLAAVWLPDADLRDARALPVLVVDGRDERELRAAIAALVDDLGDAEITVTQQSPSRTEGFDDYTVALLNRGVPSFAVDTAGTLHTALLRSCTGWPSGIWIDDPRRSAPDGSNFQLQHWTHHFDYALVSGPGDWRRAEIPARSAQFGNPLLAVAAGGGAGTGPGLPPAGSLLRVQPAESVQLAALKAAGNPLASGSAARPDPTAVALRLVETAGAGTRVAVDSDVATVSDLHAADLLEKPSRQVNSIDLHGYQVATVLARLHAPAAPAGAAALAPHAEAAQPLYARYWLHNRGPAPLGGLPAVAHLHPARASADPDSRVTLRLSAASDCTDATLAGAVVLRCPDGWSADPAELPLRLCAGQHLQADIAVSVPARAAPGLYPVRAELRLTGEHLPASWRQGVEDVCVVAVGDGERAPLIYLADEPAEVTLEPGEAADLTVTVGSHARAELALEAHLISPWGTWDWMGPAAVGAVLPARGAVDLGFRLAPPAWLDPGQWWALVRIGCAGELLYSPAVRVTVT

SEQ ID NO: 5579 - protein, 205 aa, Mycobacterium paratuberculosis
MSGHPVATVAGVPVSSVEVDAAEARLRGGRGAAALPTPGTSEGRQLRRWLTQLIVTRRVIAAEAAARGLTPAGAPNEAELLPDVTARLEIGSVAAAVLADPLARALFADVTAAVDVAERELAAYHARNPLRFAPSRPVQNVWRTTALVAPPLDEVRPVIREQLRGAARRRAFRLWLDERRAALVRLAPGYEHPGDPRQPDNTHRH

SEQ ID NO: 5580 - protein, 306 aa, Mycobacterium paratuberculosis
MLTLGLDIGGTKIAAALVDSVGTLVHTAVRPTPNPAPADDVWDVVHALIAEVVRAAGAPIAAVGIASAGPVDLPSGSVSPINIAGWHRFPLRDKVAAAVPATPVVLGGDGLCMALGEQWLGAGRGARFLLGMVVSTGVGGGLVLDGAPYPGRTGNAGHVGHVVVELDGRPCTCGGHGCVETVASGPSMVRWARENGWSAAPGAGARDLAAAAASDPLAQKAFHRSADALAAMIASVGAVCDLDVVVIGGGVAQSGPLLFDPLRERLAHYAGLDFLSGLTVVPGELGGNAGLIGAARLATLARPAGS

SEQ ID NO: 5581 - protein, 150 aa, Mycobacterium paratuberculosis
MDHSIDALAVVIMGLMVGVELAVAVFFHPLIARLPDDAFRTARGGAARALGTVMPFWYAMTLLLLGSLAVQERGAPYDWLVGVAAGLMAVVVLVTVTMLVPINNRIAKWPAGGQLSRELAARWDRRHRLRVVLLLGAYVLLTVAVTGAVT

SEQ ID NO: 5582 - protein, 196 aa, Mycobacterium paratuberculosis
MARADKATAVADIAEQFKEATATLITEYRGLTVANLAELRRSLSGAATYSVAKNTLVKRAASEAGIEGLDELFAGPTAIAFVTGEPVDAAKAIKTFAKEHKALVIKGGYMDGRALSVAEVERIADLESREVLLAKLAGAMKGNLAKAAGLFNAPASQVARLAAALQEKKAAEGPAEAPQPATEPPAEAPEAPADAE

SEQ ID NO: 5583 - protein, 130 aa, Mycobacterium paratuberculosis
MAKMSTDDLLDAFKEMTLLELSDFVKKFEETFEVTAAAPVAVAAAGPAAGGAPAEAAEEQSEFDVILESAGDKKIGVIKVVREIVSGLGLKEAKDLVDGAPKPLLEKVAKEAADDAKAKLEAAGATVTVK

SEQ ID NO: 5584 - protein, 251 aa, Mycobacterium paratuberculosis
MPDSYNIDITLLLRRYAGEGTIATMTSQPAPQRNVRDGMLAAAVALLHEHGPDALQTRKVAGAAGTSTMAVYTHFGGMRGLIAEVAEEGLRQFDAALTVPPTDDPVADLFVIGAAYRRYAIRHRHMYRLMFGSTSAHGINAPAHNVLTLTVAEIEQNYPSFAHVVRAVHRCMRAGRITAGPADDDGAVVATAAQFWASIHGFVMLELAGYCSDDGSAVLPVLGSMTSNLLVALGDSPKRVSQSMRSAMLGS

SEQ ID NO: 5585 - protein, 500 aa, Mycobacterium paratuberculosis
PPRAPSPIPYLDGFLAPVRAEVTAFDLPVTGRIPDHLDGRYLRNGPNPVAEVDPATYHWFSGDGMVHGVALRDGRARWYRNRWVRTAHVCAALGEPAPGGLDPRAGMLSVGPNTNVLGHAGQTLALVEGGGANYRLTEDLDTVGTCDFDGTLFGGYTAHPHRDPRTGELHAVSYSFGRGRRVQYSVIDTAGRARRTVDIEVSGSPMMHDFSLTDEYVVIYDLPVTFDPVQVMPADVPRWLSAPARLVVQSLLGRVQLPGPMATAMNRNRQPLHRMPYRWNDAYPARLGVMPRDGGNDEVRWFDIEPCYVYHPLNAYSEIRDGAKVLVLDVVRYSRMFDRDLRGPGDTRPTLDRWTVNLTTGAVGSELRDDRSQEFPRINEALLGRRHRFGYTVGTDGGYPSDGASEMSTGLYKHDYATGSRRVAPLDPDLLIGEMCFVPNPAGGQDGAEDDGILMGFGYHRGRDEGQLVLLDAQSLEQVATVHLPQRVPMGFHGNWVPAG

SEQ ID NO: 5586 - protein, 343 aa, Mycobacterium paratuberculosis
ASTEGSPMGVAIEVNGLTKSFGSSRIWEDVTLEIPAGEVSVLLGPSGTGKSVFLKSLIGLLRPERGSVVIDGTDILQCSAKELYEIRTLFGVMFQDGALFGSMNLFDNAAFPLREHTKKKESEIRDIVMEKLELVGLGGDEKKFPGEISGGMRKRASLARALVMDPQIILCDEPDSGLDPVRTAYLSQLILDINAQIDATVLIVTHNINIARTVPDNMGMLFRRKLVMFGPREVLLTSDEPVVKQFLNGRRIGPIGMSEEKDEATMAEEQAALEAGQHAGGVEEIEGVPPQIVASPGMPERKAVARRQARVREILHTLPQKAQAAILDDLEGTHKYRAHEVGD

SEQ ID NO: 5587 - protein, 1198 aa, Mycobacterium paratuberculosis
LPAEPTQFAANAAGGPGLRESHEVLEGCILADFRQSKTDRPQSSSNGSSSLNGSVPGAPNRVSFAKLREPLEVPGLLDVQIDSFEWLIGAPRWREAAIARGDAEPKGGLEEVLDELSPIEDFSGSMSLSFSDPRFDEVKAPVDECKDKDMTYAAPLFVTAEFINNNTGEIKSQTVFMGDFPMMTEKGTFIINGTERVVVSQLVRSPGVYFDETIDKSTEKTLHSVKVIPSRGAWLEFDVDKRDTVGVRIDRKRRQPVTVLLKALGWTNEQITERFGFSEIMMSTLEKDNTAGTDEALLDIYRKLRPGEPPTKESAQTLLENLFFKEKRYDLARVGRYKVNKKLGLHAGEPITSSTLTEEDVVATIEYLVRLHEGQPTMTVPGGIEVPVETDDIDHFGNRRLRTVGELIQNQIRVGMSRMERVVRERMTTQDVEAITPQTLINIRPVVAAIKEFFGTSQLSQFMDQNNPLSGLTHKRRLSALGPGGLSRERAGLEVRDVHPSHYGRMCPIETPEGPNIGLIGSLSVYARVNPFGFIETPYRKVVDGVVTDEIHYLTADEEDRHVVAQANSPIDDKGRFAEARVLVRRKAGEVEYVPSSEVDYMDVSPRQMVSVATAMIPFLEHDDANRALMGANMQRQAVPLVRSEAPLVGTGMELRAAIDAGDVVVAEKSGVIEEVSADYITVMADDGTRHTYRMRKFERSNHGTCANQSPIVDAGDRVEAGQVIADGPCTENGEMALGKNLLVAIMPWEGHNYEDAIILSNRLVEEDVLTSIHIEEHEIDARDTKLGAEEITRDIPNVSDEVLADLDERGIVRIGAEVRDGDILVGKVTPKGETELTPEERLLRAIFGEKAREVRDTSLKVPHGESGKVIGIRVFSREDDDELPAGVNELVRVYVAQKRKISDGDKLAGRHGNKGVIGKILPQEDMPFLPDGTPVDIILNTHGVPRRMNIGQILETHLGWVAKSGWNIDGNPEWAVNLPEELRHAQPNQIVSTPVFDGAKEEELAGMLSCTLPNRDGEVMVDGDGKAVLFDGRSGEPFPYPVTVGYMYIMKLHHLVDDKIHARSTGPYSMITQQPLGGKAQFGGQRFGEMECWAMQAYGAAYTLQELLTIKSDDTVGRVKVYEAIVKGENIPEPGIPESFKVLLKELQSLCLNVEVLSSDGAAIELREGEDEDLERAAANLGINLSRNESASVEDLA

SEQ ID NO: 5588 - protein, 1316 aa, Mycobacterium paratuberculosis
VLDVNFFDELRIGLATAEDIRQWSYGEVKKPETINYRTLKPEKDGLFCEKIFGPTRDWECYCGKYKRVRFKGIICERCGVEVTRAKVRRERMGHIELAAPVTHIWYFKGVPSRLGYLLDLAPKDLEKIIYFAAYVITSVDEEMRHNELSTLEAEMMVERKAVEDQRDADLEARAQKLEADLAELEAEGAKADARRKVRDSGEREMRQIRDRAQRELDRLEDIWNTFTKLAPKQLIVDENLYRELVDRYGEYFTGAMGAESIQKLIENFDIDAEAEQLRDVIRNGKGQKKLRALKRLKVVAAFQQSGNSPMGMVLDAVPVIPPELRPMVQLDGGRFATSDLNDLYRRVINRNNRLKRLIDLGAPEIIVNNEKRMLQESVDALFDNGRRGRPVTGPGNRPLKSLSDLLKGKQGRFRQNLLGKRVDYSGRSVIVVGPQLKLHQCGLPKLMALELFKPFVMKRLVDLNHAQNIKSAKRMVERQRPQVWDVLEEVIAEHPVLLNRAPTLHRLGIQAFEPMLVEGKAIQLHPLVCEAFNADFDGDQMAVHLPLSAEAQAEARILMLSSNNILSPASGRPLAMPRLDMVTGLYYLTTEVEGDKGEYSPAAKDRPETGVYSSPAEAIMAADRGVLSVRAKIKVRLTQLRPPAEIEAELFGANGWQPGDAWMAETTLGRVLFNELLPVGYPFVNKQMHKKVQASIINDLAERYPMIVVAQTVDKLKDAGFYWATRSGVTVSMADVLVPPRKKEILDQYEERAEKVEKQFQRGALNHDERNEALVEIWKEATDEVGQALREHYPADNPIITIVDSGATGNFTQTRTLAGMKGLVTNPKGEFIPRPVKSSFREGLTVLEYFINTHGARKGLADTALRTADSGYLTRRLVDVSQDVIVREHDCETERGIVVELAERQPDGTLIRDPYIETSAYARTLGTDAVDEAGNVIVARGEDLGDPEIDALLAAGITSVKVRSVLTCTTGTGVCATCYGRSMATGKLVDIGEAVGIVAAQSIGEPGTQLTMRTFHQGGVGEDITGGLPRVQELFEARIPRGKAPIADVTGRVRLEDGERFYKITIVPDDGSEEVVYDKLSKRQRLRVFKHEDGSERVLSDGDHVEVGQQLMEGSADPHEVLRVQGPREVQIHLVREVQEVYRAQGVSIHDKHIEVIVRQMLRRVTIIDSGSTEFLPGSLIDRAEFEAENRRVVAEGGEPAAGRPVLMGITKASLATDSWLSAASFQETTRVLTDAAINCRSDKLNGLKENVIIGKLIPAGTGINRYRNIQVQPTEEARAAAYTIPSYEDQYYSPDFGQATGAAVPLDDYGYSDYR

SEQ ID NO: 5589 - protein, 251 aa, Mycobacterium paratuberculosis
VLIGSHVRNDDPLAAAQADGADAVQFFLSNPQSWKKPKPRDDAEALKASSVPLYVHAPYLINVASANNRVRIPSRKILQDTCDAAAEINATAVIVHGGHADDNDMEAGFERWVKALDYLETDVQVYLENTAGGDHAMARHFDTIGRLWDRIGDKGIGFCLDTCHAWAAGEALIDAVDRIKALTGRIDLVHCNDSRDAAGSGADRHANFGTGQIDPDLLVTVVKAAAAPVICETADEGRKDDIAFLREHTKS

SEQ ID NO: 5590 - protein, 532 aa, Mycobacterium paratuberculosis
VPPLDNYNPAGSPVLVEALIREGGQWGLDEVNEVGALSASRQAQRWGELADRNRPILHTHDRNGYRVDEVEYDPAYHELMRTAIAHGLHAAPWADDRPGAHVVRAAKTSVWTVEPGHVCPISMTYAVVPALRFNPELAKVYEPLLTSREYDPELRVATTKPGITAGMSMTEKQGGSDVRAGTTQAVPNGDGSYRLTGHKWFTSAPMCDIFLVLAQAPGGLSCFLLPRVLPDGTRNRMFLQRLKDKLGNHANASSEVEYDGAVAWLVGEEGRGVPTIIEMVNLTRLDCTLGSATSMRTGLTRAIYHAQHRKAFGAYLIDQPLMRNVLADLAVEAEAATMVAMRMAGATDKAVRGDQREALLRRIGLAASKYWVCKRSTPHAAEALECLGGNGYVEDSGMPRLYREAPLMGIWEGSGNVSALDTLRAMATRPECVEVLFDELAEAAGQDPRLGGHVDRLRADLAELDTIQYRARKVAEDICLALQGSLLVRHGHPAVAEAFLTTRLDRRWGGAFGTMPDGLELAPILERALVKG

SEQ ID NO: 5591 - protein, 312 aa, Mycobacterium paratuberculosis
MTHAIRPVDFDNLKTMTYEVTDRVARITFNRPEKGNAIVADTPLELSALVERADLDPNVHVILVSGRGAGFCAGFDLSAYADRTGSAGGTGAYAGTVLDGKTQAVNHLTDQPWDPMIDYQMMSRFVRGFSSLMHADKPTVVKIHGYCVAGGTDIALHADQVIAAADAKIGYPPTRVWGVPAAGLWAHRLGDQRAKRLLFTGDCITGAQAAEWGLAVEAPDPADLDERTERLVQRIAAVPVNQLIMVKLALNSALLQQGVATSRMVSTVFDGVARHTPEGHAFVADAVKHGFREAVRHRDEPFGDHGRQASQV

SEQ ID NO: 5592 - protein, 239 aa, Mycobacterium paratuberculosis
MPDLTARSVVLSVLLGAHPAHARASELVRLTSDFGIKESTLRVALTRMVNAGDLIRSADGYRLSDRLLARQRRQDDAIDPKVRPWRGQWVTLIVTSVGDDARTRAALRNAMHDKRFSELREGVWMRPDNIDTQLGPDVTDRARVITARDDDPADLAGRLWDLLGWARAGHRLLDEMAAAPDVPGRFVAAAAMVRHLLTDPVLPDELLPPDWPGTRLRAAYHDFAAELMARRDPLFAEAT

SEQ ID NO: 5593 - protein, 255 aa, Mycobacterium paratuberculosis
MSDPVRIERNGPVTTVIINRPAARNAVNGPTAAALYAAFEEFDRDDSASVAVLWGEGGTFCAGADLKAFGTPEANAVHRSGPGPMGPTRMVLSKPVIAAVSGYAVAGGLELAIWCDLRVVEQDAVFGVFCRRWGVPLIDGGTVRLPRLIGHSRAMDMILTGRAVAADEAQAIGLANRVVPKGQSRRAAEELAAQLAALPQQCLRSDRLSALHQWGATESEALDFEFASISRVAAEANEGAGRFAAGAGRHGASAV

SEQ ID NO: 5594 - protein, 161 aa, Mycobacterium paratuberculosis
MPARTPTPVRDRWLRLTVAPAAALLLAGCSSTANPPAGSSTTTTKSTATTSAGAAPTTGSGGASTTASIEIGNTINYGSMGTTTTLDCAGGKSLNVGGSDNTLTVTGTCESATVSGTNNKITFDKVNTRITVLGMNNTITYKDGDPKVDKIGQSNTINKGG

SEQ ID NO: 5595 - protein, 125 aa, Mycobacterium paratuberculosis
VKWTTVAGSLAACALAVLAGAVAPPRVAQAKNGDTHIIGQDTEQTIDCNDATLLVNGTGNVVTALGNCYAVTVMGSSNTVIADSVSHDITVYGYDQTVFYKSGQPFLWDRGRELGMTNRLQQVPG

SEQ ID NO: 5596 - protein, 210 aa, Mycobacterium paratuberculosis
MAAQPEPPTAAGRQRAGRPAARPAKLSREGIIDGALTFLDREGWDALTINALATQLGTKGPSLYNHVDSLEDLRRAVRIRVIDDIITMLNRVGEGRARDDAVLVMAGAYRSYAHHHPGRYSAFTRMPLGGDDPEYTAATRGAAAPVISVLSSYGLDGEEAFHAALEFWSALHGFVLLEMTGVMDDIDTDALFSDMVLRLAAGLERRTAHG

SEQ ID NO: 5597 - protein, 124 aa, Mycobacterium paratuberculosis
MPTIQQLVRKGRRDKIGKVKTAALKGSPQRRGVCTRVYTTTPKKPNSALRKVARVKLTSQVEVTAYIPGEGHNLQEHSMVLVRGGRVKDLPGVRYKIIRGSLDTQGVKNRKQARSRYGAKKEKS

SEQ ID NO: 5598 - protein, 156 aa, Mycobacterium paratuberculosis
MPRKGPAPKRPLVNDPVYGSQLVTQLVNKVLLKGKKSLAERIVYGALENAREKTGTDPVITLKRALDNVKPALEVRSRRVGGATYQVPVEVRPDRSTTLALRWLVSFSRQRREKTMVERLANEILDASNGLGASVKRREDTHKMAEANRAFAHYRW

SEQ ID NO: 5599 - protein, 701 aa, Mycobacterium paratuberculosis
VAQKDVLTDLTKVRNIGIMAHIDAGKTTTTERILYYTGISYKIGEVHDGAATMDWMEQEQERGITITSAATTCFWNDNQINIIDTPGHVDFTVEVERSLRVLDGAVAVFDGKEGVEPQSEQVWRQADKYDVPRICFVNKMDKIGADFYFSVRTMEERLGANVIPIQIPVGSEGDFEGVVDLVEMKAKVWSAEAKLGEKYDVVDIPADLQEKAEEYRTKLLEAVAETDEALLDKYLGGEELTIEEIKGAIRKLTISSEAYPVLCGSAFKNKGVQPMLDAVIDYLPSPLDVPPAEGHVPGKEEELITRKPSTDEPFSALAFKVATHPFFGKLTYVRVYSGKVDSGSQVINSTKGKKERLGKLFQMHSNKENPVETASAGHIYAVIGLKDTTTGDTLSDPNHQIVLESMTFPDPVIEVAIEPKTKSDQEKLSLSIQKLAEEDPTFKVHLDQETGQTVIGGMGELHLDILVDRMRREFKVEANVGKPQVAYKETIRRKVENVEYTHKKQTGGSGQFAKVIINLEPFTGEDGATYEFENKVTGGRIPREYIPSVDAGAQDAMQYGVLAGYPLVNLKVTLLDGAFHEVDSSEMAFKIAGSQVLKKAAAQAQPVILEPIMAVEVTTPEDYMGDVIGDLNSRRGQIQAMEERSGARVVKAHVPLSEMFGYVGDLRSKTQGRANYSMVFDSYAEVPANVSKEIIAKATGQ

SEQ ID NO: 5600 - protein, 396 aa, Mycobacterium paratuberculosis
VAKAKFERTKPHVNIGTIGHVDHGKTTLTAAITKVLHDKYPDLNESRAFDQIDNAPEERQRGITINISHVEYQTDKRHYAHVDAPGHADYIKNMITGAAQMDGAILVVAATDGPMPQTREHVLLARQVGVPYILVALNKADMVDDEELLELVEMEVRELLAAQEFDEDAPVVRVSALKALEGDAKWVESVEQLMEAVDESIPDPVRETDKPFLMPVEDVFTITGRGTVVTGRVERGVINVNEEVEIVGIRPSSTKTTVTGVEMFRKLLDQGQAGDNVGLLLRGIKREDVERGQVVTKPGTTTPHTEFEGQVYILSKDEGGRHTPFFNNYRPQFYFRTTDVTGVVTLPEGTEMVMPGDNTNISVKLIQPVAMDEGLRFAIREGGRTVGAGRVVKIIK

SEQ ID NO: 5601 - protein, 205 aa, Mycobacterium paratuberculosis
MSFVQATPEFVAAAATDLARIGSTISSANTAALGPTSGVLAPGADEVSASIAALFDAHSQVYQALSAQAAAFHSQFVQLMNGGALQYAVTEAANTTPLQSAAGPASVAAQLPAVSGAVGGSAPYGHPTAPLAAAAGASRYTRDGAGSEHPGGGTQRRGVLGTDSRPDPGQIRRGSRDEFRSRLNERHRHHPATSYGPRGTTTAKS

SEQ ID NO: 5602 - protein, 282 aa, Mycobacterium paratuberculosis
VLARYLKAQLVVLLCGGLVGPIFLVVYFTLGLGSLLQWMFYVGLLITVADVLIALALANYGAKSSEKLAALEQNGVLALAQITGITETGTWVNNQQVVKVHLHIAGPGLVPFDSEDRVIASVTRLGNLNARKVVVLVNPTTNEYRIDWERSALVNGLVPAQFTVAEDNTTYDLSGQAGPLMEILQILKANNIPLNRMVDIRSNPALRAQIQAVVRRAAQQQAPAGQPAPAGQPATGQPSAPVAAPPGPSIAARLQELNDLHASGALTEQEYNSRRAAIIAEI

SEQ ID NO: 5603 - protein, 275 aa, Mycobacterium paratuberculosis
VAGQAGSLQGRVAFITGAARGQGRSHAVRLAAEGADIIACDICAPVSASVTYAPASPEDLDETARLVEDQGRKALTRVLDVRDDAALRELVADGMEQFGRLDVVVANAGVLSWGRVWELTDEQWDTVIGVNLTGTWRTLRATVPAMIEAGNGGSIVVVSSSAGLKATPGNGHYSASKHGLTALTNTLAIELGEYGIRVNSIHPYSVETPMIEPEAMMEIFARHPSFVHSFPPMPVQPNGFMTADEVADVVAWLAGDGSGTLTGTQIPVDKGALKY

SEQ ID NO: 5604 - protein, 398 aa, Mycobacterium paratuberculosis
VSSDASASNGIVIVGGGLAAARTAEQLRRSEYSGPITIVSDEVHLPYDRPPLSKEVLRKEVDDTALKPRQWYDDNDITLRLGSAARSLDTAAQTLTLEDGTTLGYDELVIATGLVPRRIPTIPDLDGIRVLRTFDESLALREHASAAQRAVIIGAGFIGCEVAASLRSLGVDVVLVEPQPTPLAAVLGEQIGELVARLHRAEGVDVRLGVGVAQVRGDTHVEAVVLTDGTELAADVVVIGIGSRPATDWLEGSGVAIDSVDRGVLCDEAGRTSAPNVWALGDVASWRDATGHQGRVEHWSNVADQARVVVPAMLGKEVPPVVVVPYFWSDQYDVKIQCLGEPEADDIVHIVEDDGRKFLAYYERDGALVGVVGGGMPGKVMKTRAKIAAAVPIAEMLG

SEQ ID NO: 5605 - protein, 275 aa, Mycobacterium paratuberculosis
MKSMQELFEIAWQATQIGATTLKKTQPSSVQHKGDRDLVSDVDLTIQRDIANYLSQTTPDVALLAEESDHQPDIETAEWLWVLDPVDGTSNFVHGLPLCAVSLALLHAGRTVVAVTHAPLLGKTYHAIESKGAFVNGERITASATDSLSGAIVSLGDYAVGHDAGRLNAHRLALTAELVPRAERIRMIGAATLDLAFVAEGALDACVMMSNKPWDTAAGTLIAREAGARLTDAQGNPHTHKSASTVVAAPGIAEQLATVIRNTEVPSDRYAAAVG

SEQ ID NO: 5606 - protein, 286 aa, Mycobacterium paratuberculosis
VTVIDEIYSSSSAIPTVALNDEAKKPVLGLGVAKLSDEETESSVLAALEAGCRLIDTAASYGNEAAVGRAIAASGIPREELFVTTKLGTSRQGFHSAQESCKESLDRLGLDYLDLYLIHWPAPTLGKYVESFEGMIEARERGHVRSIGVSNFTEDLLATVIEETNEVPAVNQVELHPRLNQAELRQVHAQHDVTTQSYSPLGVGRLIEEPTVTTIAAEYGRTPAQVLVRWNLQLDNVVVSRSSKPERVAENLDVFDFTLEPEHMEAIEGLHDGTRVLHDPMTFMGT

SEQ ID NO: 5607 - protein, 347 aa, Mycobacterium paratuberculosis
VSVEHLVHMLRAQGSFCASSGSPMYGDLFELVASDVEAGGVFADILSGHRDAPSRDAIPLRLLGGLHRLVLDGRAGSLRRWYPSTGGSWDAGAAWPPILAAAAEHAAALRAALDRPPQTNEVGRSAALIGGLLHINESCLPVRLFEIGSSAGLNLRADHYRYRYAGGGWGPADSPVCIDDAWRGALPPARGVRIVERHGFDIAPVDVGNPDGELTVLSYVWPDQAARLARLRGAIEVARRVPATLERRTAADAVGRLSLAEGALTVLWHSITWQYLSAGERAAVCAGVDALGARAGASAPLVHLTMEPARDGPGAPIRFLVRARGWPDGGPRVLAQCHPHGPPVDWL

SEQ ID NO: 5608 - protein, 210 aa, Mycobacterium paratuberculosis
MASSAEMEGPGSGMPQQRVGRRRSTTPHHITDVAIDLFTARGFAEVSVDDVAAAAGISRRTLFRYYASKNAIPWGDFDTHLARLRELLDNVESRVPLGDALRTALLAFNTFDESETARHRQRMRVILQTAELQAYSMTMYAGWREVIAGFVARRCECKTTDLAPQTVAWMMLGVALSAYEHWLGDESVPLPVALGNAFDVVGAGLNGLDR

SEQ ID NO: 5609 - protein, 109 aa, Mycobacterium paratuberculosis
VRGLLTVPAPAQARAAGAAFDPDRGWRLHPQVAVRPEPFGALLYHFGTRKLSFLKNRTILTVVQSLAEYPDVRCACRAAGIDDAGQAPYLHALGVLADSNMLVPREDHP

SEQ ID NO: 5610 - protein, 404 aa, Mycobacterium paratuberculosis
MTTVAPVPRLIEQFEHGLDAPICLTWELTYACNLACVHCLSSSGKRDPRELSTRQCMDIIDELERMQVFYVNIGGGEPTVRPDFWELVDYATAHHVGVKFSTNGVRITPEVAARLAASDYVDVQISLDGATAEVNDAVRGPGSFDMAVRALQNLADAGFTQNGGAKISVVVTRHNVGQLDEFAALASRYGATLRITRLRPSGRGADVWDELHPTADQQVQLYDWLVAKGERVLTGDSFFHLAPLGQSGALAGLNMCGAGRVVCLIDPVGDVYACPFAIHDRFLAGNVLSDGGFDNVWKNAPLLRELREPQSAGACGSCGHYDSCRGGCMAAKFFTGLPLDGPDPECVQGHSAAALAGDREAPRPRADHSRGKRIRQPVPLTLSVRPPVLTPAAPPARLCNESPV

SEQ ID NO: 5611 - protein, 394 aa, Mycobacterium paratuberculosis
VADEWFETVAIAQQRAKRRLPKSVYAALIAASEKGITVSDNVEAFGELGFAPHVVGAPAKRELTTTVMGQEISMPVLISPTGVQAVDPDGEVAVARAAAARGTAMGLSSFASKPIEEVIAVNPKVFFQVYWLGGRDAIAERVERARQAGAVGLIVTTDWSFSHGRDWGSPKIPEEMNLRTILRLSPEAVFKPRWLWKFGKTLRPPELRVPNQGRRGEPGPPFFAAYGEWMGTPPPTWEDIAWLRELWGGPFMLKGVMRVDDAKRAVDAGVSAISVSNHGGNNLDGTPASIRALPAIAEAVGDQIEVLLDGGVRRGSDVVKAVALGARAVMIGRAYLWGLAAAGQAGVENVLDILRGGIDSALMGLGHSSVHDLGPSDILVPPGFTRALGVPPAG

SEQ ID NO: 5612 - protein, 243 aa, Mycobacterium paratuberculosis
VNSSYHHRVSVLGELGTVTSSQLSGTAVSLLVPLGSTEQHGPHLPLDTDTRIASAVAGRAVPRLGDDWLVAPAIAYGASGEHQSFAGTVSIGTEALTLLLIEYGRSAAGWAQRVVFVNGHGGNVAALGRAVGTLRAEGRDAGWCPCVAAGGDAHAGHTETSVLLHISPAEVRTGAWQAGNRAPLPELLGSMRRGGVAAVSPVGVLGDPTTATAAEGERILSEMVNECVRRVARWRPGPDGMLA

SEQ ID NO: 5613 - protein, 217 aa, Mycobacterium paratuberculosis
MTAPAPRLPDGFAVQVDRRVRVLGDGSALLGGSPTRLLKLAPAAQDLLCDGRLKVRDDVSAQLARTLLDATVAHPRPAGGPSHHDVTVVIPVRDNLSGVRRLVSSLRGLRVVVVDDGSFPPIEPEDFVGAHCDIEVLRHHRSKGPAAARNTGLAACRTDFVAFLDSDVAPRRGWLEALLGHFCDPTVGAGRAAHRRPVAQRERGGPLRGGALLARPR

SEQ ID NO: 5614 - protein, 306 aa, Mycobacterium paratuberculosis
MSRRAGAGWKRCSATSATRPSGLVAPRIVGLSHSENVVARYEAVHSSLDLGEREAPVLPHSTVSYVPSAAIICRCSAIREIGGFDETLQSGEDVDLCWRLIEAGVRLRYEPIALVGHDHRTELRDWLARKAFYGGSAAPLSVRHPDKTAPVVISGWALMTWILMAFGSTLSRLASLLLAVLTGRRIARAMRSAETSMTDVVTVAGRGLWSAALQLASALCRHYWPLALLAATMSRHFRRVVLVAAVMDGVVDWLRRRDAVGDDVEPIGLPTYLVLKRVDDLAYGLGLWWGVLRERNARALKPQIRS

SEQ ID NO: 5615 - protein, 479 aa, Mycobacterium paratuberculosis
LKNAVSHSDVLIVGVGSAGSVVAERLSADPGCTVTVVEAGPALDDPALLARTANGLQLPIGVGSPLVRRYQTQLTERPARRHPLVRGATIGGSGAINGGYFCRGLPRDFDRLGLPGWAWSDVLDSFRAIETDLDFDGPAHGRSGPILVRRTREMTGTTERFIDAARRAGFGWIDDLNDAAAQPVSGIGAVPLNIVDGVRKGSGAGYLIPALSRPNLRVQAHSRVARLRLAGTVARGADVVGPHGRATLTADRIVLCAGAIETAHLLMLSGIGEPGMLRAAGVPVRVALPVGTSFSDHAEWVLPTDWPVAPGRPVLEVVLSTADHLEIRPYTGGFVAMTGDGTAGHADWPHLGVALMQPRARGCLTLVSADPAVPPRIEHRYDSEPGDVAALARGAELARELAGGTTDAAAVIWSTSQHLCGTAPMGVDGDPRAVVDPRCRVRGIDNLWVIDGSVLPAITSRGPHATIVMIGHRAAEFVR

SEQ ID NO: 5616 - protein, 181 aa, Mycobacterium paratuberculosis
VTVDAVTRTANVARATLYRHFPSGNDLLAAAFNSLIPASPTPPAEGSLRDRLVAVVLAQAEAVAQAPTMMTAMTWLALGRDLEAWPQPRADDSVAITTLRERIAQQYSEPFDVIFDSPEAAELGEVDRSRAIALLIGPLVLGRLSTLPDFDYRECALAAVDGFLHVQRARARAARVESAGA

SEQ ID NO: 5617 - protein, 101 aa, Mycobacterium paratuberculosis
VAGQKIRIRLKAYDHEAIDASARKIVETVVRTGASVVGPVPLPTEKNVYCVIRSPHKYKDSREHFEMRTHKRLIDILDPTPKTVDALMRIDLPASVDVNIQ

SEQ ID NO: 5618 - protein, 217 aa, Mycobacterium paratuberculosis
MARKGILGTKLGMTQVFDENNRVVPVTVVKAGPNVVTRIRTPEQDGYSAVQLAYGEISPRKVNKPVTGQYAAAGINPRRFLAELRLDNPDAAAEYQVGQELTAEIFTDGSYVDVTGTSKGKGFAGTMKRHGFRGQGASHGAQAVHRRPGSIGGCATPARVFKGTRMAGRMGNDRVTVQNLLVHKVDTENGVLLIKGAVPGRTGGLVMVRSAVKRGEK

SEQ ID NO: 5619 - protein, 217 aa, Mycobacterium paratuberculosis
MALKLDVKAPGGKVEGSIELPAELFDAPANIALMHQVVTAQRAAARQGTHSTKTRGDVSGGGRKPYRQKGTGRARQGSTRAPQFTGGGVVHGPKPRDYSQRTPKKMIAAALRGALSDRARNGRIHAITELVSGQTPSTKSAKAFLGALTERKQVLVVIGRSDEAGAKSVRNLPGVHILAPDQLNTYDVLRADDVVFSVEALRAYIAANTGTPEEVSA

SEQ ID NO: 5620 - protein, 100 aa, Mycobacterium paratuberculosis
MATVTDPRDIILAPVISEKSYSLLDDNVYTFVVHPDSNKTQIKIAIEKIFSVKVASVNTANRQGKRKRTRTGFGKRKSTKRAIVTLAPGSKPIDLFGAPA

SEQ ID NO: 5621 - protein, 280 aa, Mycobacterium paratuberculosis
MAIRKYKPTSPGRRGASVSDFSEVTRSTPEKSLVRPLHGHGGRNAHGRITTRHKGGGHKRAYRVIDFRRNDKDGVNAKVAHIEYDPNRTANIALLHFLDGEKRYIIAPQGLSQGDVVESGPNADIKPGNNLPLRNIPAGTVIHAVELRPGGGAKLALSAGSSIQLLGKEGSYASLRMPSGEIRRVDVRCRATVGEVGNAEQANINWGKAGRMRWKGKRPSVRGVVMNPVDHPHGGGEGKTSGGRHPVSPWGKPEGRTRHPNKASNKLIVRRRRTGKKHGR

SEQ ID NO: 5622 - protein, 93 aa, Mycobacterium paratuberculosis
MPRSLKKGPFVDGHLLKKVDAQNEKNTKQVIKTWSRRSTIIPDFIGHTFAVHDGRKHVPVFVTEAMVGHKLGEFAPTRTFKGHIKDDRKAKRR

SEQ ID NO: 5623 - protein, 180 aa, Mycobacterium paratuberculosis
MTTTEFPSAVAKARFVRVSPRKARRVIDLVRGRSVTDALDILRWAPQAASEPVAKVIASAAANAQNNNGLDPATLVVATVYADEGPTAKRIRPRAQGRAFRIRKRTSHITVVVESRPAKDQRSAKSSRTRRAEASKAAAKAPAKKAPAKKAPAKKAPAKTAAKKAPAKTSETSDAKGGSD

SEQ ID NO: 5624 - protein, 280 aa, Mycobacterium paratuberculosis
VGQKINPYGFRLGITTDWKSRWYADKQYADYVKEDVAIRRLLSTGLERAGIADVEIERTRDRVRVDIHTARPGIVIGRRGTEADRIRADLEKLTGKQVQLNILEVRNPESQAQLVAQGVAEQLSNRVAFRRAMRKAIQSAMRQPNVKGIRVQCSGRLGGAEMSRSEFYREGRVPLHTLRADIGYGLYEAKTTFGRIGVKVWIYKGDVVGGKRELAAAAPAGAERPRRERPSGTRPRRSGASGTTATGTEAGRAAASADESTAAGQPAEAAPAAEPQSTES

SEQ ID NO: 5625 - protein, 138 aa, Mycobacterium paratuberculosis
MLIPRKVKHRKQHHPRQRGIASGGTAVNFGDYGIQALEHAYVTNRQIESARIAINRHIKRGGKVWINVFPDRPLTKKPAETRMGSGKGSPEWWVVNVKPGRVLFELSYPNEQTARAALTRAIHKLPIKARIVTREDQF

SEQ ID NO: 5626 - protein, 77 aa, Mycobacterium paratuberculosis
MAVGISPGELRELTDDELTERLRESKEELFNLRFQMATGQLTNNRRLRTVRQEIARVYTVLRERELGLASGPDGKES

SEQ ID NO: 5627 - protein, 117 aa, Mycobacterium paratuberculosis
VMAEAKKAAPKKAATAASKDADAKGPKHTPPNPKVRGRRKTRIGYVVSDKMQKTIVVELEDRVKHPLYGKIIRTTKKVKAHDENSIAGIGDRVSLMETRPTSATKRWRLVEILEKAK

SEQ ID NO: 5628 - protein, 789 aa, Mycobacterium paratuberculosis
MVAGSGQSAEFSGRVELDIRDSEPDWGPYAAPTAPPNAPNILYLVWDDTGIATWDCFGGLVEMPAMSRIAERGVRLSQFHTTALCSPTRAALLTGRNATTVGMATIEEFTEGFPNANGRIPFDTALLSEALAEHGYNTYCVGKWHLTPLEESNMASTKRHWPTSRGFERFYGFLGGETDQWYPDLVYDNHPVSPPATPEDGYHLSKDLADKTIEFIRDAKVIAPEKPWFSYVCPGAGHAPHHVFKEWADRYAGRFDMGYERYREVVLERQKAMGIVPSDTELSPVNPYLDVTGPRGEPWPLQDTVRPWDSLNDEEKKLFARMAEVFAGFLSYTDAQIGRILDYLEESGQLDDTIIVVISDNGASGEGGPNGSVNEGKFFNGYIDTVEESMKLFDQLGGPQTYNHYPIGWAMAFNTPYKLYKRYASHEGGIADTAIISWPNGIAAHGEIRDNYVNVCDITPTVYDLLGMSPPETVKGIAQKPLDGVSFKAALDDPNADTGKTTQFYTMLGTRGIWHEGWFANTVHAATPAGWSHFDADRWELFHIEADRSQCHDLAAENPDKLEELKALWFAEAARYNGLPLSDLNILETMTRSRPYLVGERDSYVYYPDCADVGIGAAAEIRGRSFSVLAEATVDTTGAEGVLFKQGGAHGGHVLFIQDGRLHYVYNFLGERQQEVSSSVPVPLGRHLFGASYARTGTVPDSHTPLGDLTLFIDDEVVGTLAGVSTHPGTFGLAGAGITVGRNGGSGVSSRFKAPFVFTGGTIARVTLDLSGRPYRDVETEIALAFSRD

SEQ ID NO: 5629 - protein, 396 aa, Mycobacterium paratuberculosis
LFACSSGRGTSRYPDCQGALVVMRTRSAVIAGVLMATTLVVSACGETPASLPYTAGAKVDCGGKQTLSASGSTAQANAMTRFIAAYRTACPGQTLDYTANGSGNGIGDFLAGRTDFAGSDTPLSGDQYAAAKRRCGGADAWNLPVVFGPLAITYNLAAVDSLVLDAPTLAKIFNGTITRWDDPALALLNASMPAEDIRVVYRSDGSGTTDNFQAYLQSAAGGVWNKGAGKTFNGGVGTGAVGNTGTAAAVKSTEGAISYNELSFALQQGLFAAEIKTPASRRSLRPVRIGTDIFGKTIKGARIVGTGNDLVLDLSSFYNPAQPDVYPIVLATYEIVCSKYPGFDVAKAVKAFLQAAIGPGQVELARTGYIPLSADFQAKVSGAVDAISSPQAPNPD

SEQ ID NO: 5630 - protein, 313 aa, Mycobacterium paratuberculosis
MTHQAPPAPPPSVPSEQPPAAPPDAPPARRRRRPVIAAAVVLGFVAVYVLSLFGVHLLAKTAGPLKPPDLNATSDTVVLVRLEKLDTIANRLTVKVLVIPEESMFDKRLDVLTTDTAVRMDPPNDLGDLQYPAGKSPAQVATTIEAHGNPNNWPFYSYRTDTMSAEVLVGQGDTRHYIPARVEVTGGLDGWDVSVQRVGEASQESDRADNVIITLHRSKSTLIFDAGICLVLFALPAMALTIALLMLTGKRGFLPPFVTWFAALLFAVIPIRNFLPGSPPAGAWVDQALVLWVLIALVASMVLFLITWYRRTD

SEQ ID NO: 5631 - protein, 296 aa, Mycobacterium paratuberculosis
VRSELADLPGGSFRMGSTSFYPEEAPIHTVTVEPFAIERHPVTNAQFAEFVAATGYVTVAEQPIDPALYPGADPSQLQPGAMVFRPTPGPVDLRDWRQWWHWVPGASWRHPFGPDSDVADRADHPVVQVAYPDAAAYARWAGRRLPTEAEWEYAARAGATTTYPWGDEPTSDGRLMANTWQGRFPYRNDGALGWVGTSPVGVFAPNAFGLLDMIGNVWEWTTTEFSTHHRIGAATKPCCAPSGPADPSVNQTLKGGSHLCAPEYCHRYRPAARSPQSQDSATTHIGFRCVAELGSN

SEQ ID NO: 5632 - protein, 306 aa, Mycobacterium paratuberculosis
MTATAVAAQAPVTKKRDRPRIAIGVCILAGVVIVYVLSLFGVHFLQRSEGPLPPLDLSQGGGDATIVQLRLEELKPVANRLSVNVLVYPGVAQYDNRFDVLANDVAVRLYPTSDLGDLHYPKGKAPAQLSTTVEAHGDPGNWPFDSYRTEPISADAFVGSGDNLKKVPARVEVTGALDGWQITVDRVRDPAALPTQRGSDNGDVVITLKRAKGPLIFDLGICLVLISLPTLALLVAIPMAMGRRKFLPPFATWYAANLFAIVPLRNILPGAPPPGSWIDQAIVQWVLIALVAAMTLYIIAWVRQGD

SEQ ID NO: 5633 - protein, 500 aa, Mycobacterium paratuberculosis
MFEDAVAWFDELMERCYPSATPESAALVQRIGVFARVENRAAAEQLAAIGELFAYRLSRCSECEDWAVDTEAAVSAEVAAQLRIGQGLAAAKVRYARAMRERLPRVGEVFRAGEIDFRLFATIVYRTDLITDRRVLAAVDAELAATAARWPSMTRARLAARVDAVVAKADADAVRRAEKQAATRHVWIAEMGEGLSHLEGTVSSPDAHALDKRLDALAATVCEHDPRTGEQRRADALGALAAGADRLGCRCGRADCAAGTGPAAGPVVIHVIAERASVEGTGGGPAVEVGAEGLLPAQLVAELAASARLMPLVHPADSSPENRYTPSAALADFVRCRDLTCRWPGCDRPATECDLDHTIPYAEGGPTHASNLKCYCRTHHLVKTFWGWREQQLPDATLILTSPAGQTYVTTPGSALLFPSLCVPTGEPARPVAAGSQPCGERTAMMPTRRRTRGQNRAARVAAERRANRAARLARATRPAPAASQSWPAGHGPDADPPPF

SEQ ID NO: 5634 - protein, 122 aa, Mycobacterium paratuberculosis
VIQQESRLKVADNTGAKEILCIRVLGGSSRRYAGIGDVIVATVKDAIPGGNVKRGDVVKAVVVRTVKERRRPDGSYIKFDENAAVIIKPDNDPRGTRIFGPVGRELREKRFMKIISLAPEVL

SEQ ID NO: 5635 - protein, 105 aa, Mycobacterium paratuberculosis
MKVRKGDTVLVIAGKDKGAKGKVLKAYPDRERVLVEGVNRIKKHTAISTNQRGAQSGGIVTQEAPIHVSNVMVVDSDGKPARVGYRLDEETGKRVRISKRNGKDI

SEQ ID NO: 5636 - protein, 187 aa, Mycobacterium paratuberculosis
MTTTEKVQPRLKERYRNEIRDSLQQQFGSANVMQIPTVTKVVVNMGIGEAARDAKLINGAVNDLALITGQRPEIRRARKSIAQFKLREGMPIGARVTLRGDRMWEFLDRLTSIALPRIRDFRGLSSKQFDGVGNYTFGLAEQSVFHEIDVDKIDRVRGMDINVVTSATTDDEGRALLRALGFPFKEN

SEQ ID NO: 5637 - protein, 61 aa, Mycobacterium paratuberculosis
MAKKALVNKAARKPKFAVRGYTRCNKCGRPRAVFRKFGLCRICLREMAHAGELPGVQKSSW

SEQ ID NO: 5638 - protein, 132 aa, Mycobacterium paratuberculosis
MTMTDPIADFLTRLRNANSAYHDEVTLPHSKLKANIAQILKNEGYISDFRTEDARVGKSLIVQLKYGPSRERSIAGLRRVSKPGLRVYAKSTNLPRVLGGLGVAIISTSSGLLTDRQAARQGVGGEVLAYVW

SEQ ID NO: 5639 - protein, 179 aa, Mycobacterium paratuberculosis
MSRIGKQPVPVPAGVDVTIDGQKVSVKGPKGTLDLTVAEPITVSRNDDGAIVVTRPNDERRNRSLHGLSRTLVSNLVTGVTQGYTTKMEIFGVGYRVQLKGSNLEFALGYSHPVVIEAPEGITFAVQSPTKFSISGIDKQKVGQISANIRRLRRPDPYKGKGVRYEGEQIRRKVGKTGK

SEQ ID NO: 5640 - protein, 135 aa, Mycobacterium paratuberculosis
MAQTQADTAARKPVGQSVSATRRVSRLRRHARLRKKIAGTPERPRLVVNRSARHIHVQLVNDENGTTVAAASSIEDDVRSLQGDKKARSVRVGQLIAERAKAAGIDSVVFDRGGYTYGGRIAALADAARENGLQF

SEQ ID NO: 5641 - protein, 224 aa, Mycobacterium paratuberculosis
MAEQPAGGQGAGDSRDSRGDRDSRGRRGDGGRGGRDRDGDKSNYLERVVAINRVSKVVKGGRRFSFTALVIVGDGNGMVGVGYGKAKEVPAAIAKGVEEARKGFFRVPLIRGTITHPVQGEAAAGVVLLRPASPGTGVIAGGAARAVLECAGVHDILAKSLGSDNAINVVHATVAALKLLQRPEEVAARRGLPIEDVAPAGMLKARRESDALASAAAAREAAAQ

SEQ ID NO: 5642 - protein, 71 aa, Mycobacterium paratuberculosis
MSQLKITQVRSTIGARWKQRESLRTLGLRRIRHSVIREDNPQTRGLIAVVSHLVEVAPADASSAGTGGSKK

SEQ ID NO: 5643 - protein, 146 aa, Mycobacterium paratuberculosis
MTIKLHDLKPARGSKTPRTRVGRGEGSKGKTAGRGTKGTKARKNVPVTFEGGQMPIHMRLPKLKGFRNRFRTEYEIVNVGDINRLFPQGGSVGVDELVAKGAVRRNSLVKVLGDGKLTVKVEVSAHKFSGSAREKITAAGGSVTEL

SEQ ID NO: 5644 - protein, 308 aa, Mycobacterium paratuberculosis
VRFSIAIPQFDYDGFDGAGLRSFLTRAEQLGFEGGWALEQIIGPAPLLAPLELLAYCAACTERLRLGVAVLVTSLHDPLQLASAVTAVDRLSHGRLDIGVAPGGGTRKFAAFGVDKDTFVAYFTEGLKLMKAAWSDDPRVTFHGRFRDVDDLPIAPKPLQRPHPPIWFGGLAPKALARAVRHGDAFMGAGSSTTEAFAGAVAVLRRELDEQQRDPAEFTIGKRVYLTVDDDAARARERVLAGLGRIYGRMPGVADVPVSGTPGDVVRGLREVIDAGAQTLLLNPVGADVAENHEQMERLAAEVIPQLN

SEQ ID NO: 5645 - protein, 595 aa, Mycobacterium paratuberculosis
MFAVLSSIPGLSKGADEIRALAGRVDTARHHGVPNGCVLELDLRSMPPETSGFDPLALVTGGSRPASLRDTVDAIHRAAEDPRVAGLIARVQLAPSPSAAVQELREAIVAFTAAKPSLAWAETYPGTLSYYLASAFGEIWMQPGGSVGLIGFASNATFLRDALDKAGIEAQFVARGEYKSAVNRFTEHGFTEAHREAVTRMLDSVQEQVWQAVAESRKLDTDALDALADRAPLLRQDALDSGLVDRIGFRDQAYDRIAELVGVQDVSPDTEPPRLYVSRYAGAARSRLSPPVPSLPGRRRPPTVAVINVDGTLVDGRGGPHFLPFGAATVGSDTIAPALREAAADDAVSAIVLRVNSPGGSVTASETLWREVKRARERGKPVVASMGAVAASGGYYVSVAADAIVANPATITGSIGVITGKLVIRDLLGRLGVGSDTVRTNANADAWSIDAPFTPEQRAHREAEADLVYTDFVSRVAEGRNLTTDAVERVARGRVWTGADAHERGLVDELGGFRIAVRRAKILAGLDEDADVRIVTYPSGSLLDVLRPRASSQPAAVSLPDALGALTVKTLGAILDNVERSCSGASALWLGPSRL

SEQ ID NO: 5646 - protein, 304 aa, Mycobacterium paratuberculosis
MTRTHDDEWDLASSVGATATMVAAGRAMATKDPRGLIDDPFAEPLVRAVGVDFFTKMMDGELDLDAIENATPVRIQSMVDGMAVRTKYFDDYFVDATDAGVRRVVILASGLDSRAYRLPWPAGTVVYEIDQPRVIEFKSNTLAEVGAEPTATRRTIPIDLRGDWPAALSAAGFDPAAPTAWLAEGLLIYLPPEAQDRLFDNITALSAPGSTIATEFVPGIVDFDAERVREMSGSFRQHGVDIDMASLVYAGERNHVIDYLNGLGWRAEGVTRTELFHRHGIEVPAPENDDPLGEIIFISATRTR

SEQ ID NO: 5647 - protein, 306 aa, Mycobacterium paratuberculosis
MSEGRTDGDTWGPAQSVGATATMVAAARAVASQGPDALLDDPLAEPLVRAVGLDPFIRIVEGKLDFPDDPLFNRRARAEQITVRTRFFDDFFIDATEAGLRQAVILASGLDTRAYRLTWPAGTVVYEIDQPQVIAFKTDTLANLGAAPTAERRTISIDLRDDWPAALREGGFDVTRPTAWSAEGLLPYLPPEAQDRLFDNITALSAPGSRLATEHVPDPNAFSDERLARISERWQRLGLNLNAADLFYRGERNVVADYLTGKGWRVTPHPARQLYARNGFEFPEDEMRATFGEMSYVDATLTGGRG

SEQ ID NO: 5648 - protein, 356 aa, Mycobacterium paratuberculosis
LPAYVISKGCRESREAYSGGSLLYRLNISLATTSTISDRGAHMTSTRYEGDTWDLASSVGVTATMVAAARAMATRADNPLINDLFAEPLVKAVGVDLLSRLAGGELDPAELNDVHDGAAGSAGAMSRMADNMAVRTKFFDEFFLNATKAGIAQVVILASGLDARAYRLAWPAGTVVYEVDQPQVIDFKTTALAQLGAAPTAERRVVAVDLRDDWPAALRAAGFDPARPTAWSAEGLLGYLPPEAQDRLLDTITELSAPGSRLATESAPNPAPGEEEKLKERMQAISQRWRAHGFDLDMAGLVYFGERNEAAPYLAGHGWRLNSVTIRDLFAANGLDPLDDDDTRMGEMLYTWGIYE

SEQ ID NO: 5649 - protein, 410 aa, Mycobacterium paratuberculosis
MKALVYGVAPEPVAVPDDANPLVQNLARTPTGLRDMPEPVLPHEDWVLTRPRLTGICGSDAKQILMDFGEGDADNAMSAFCSFPQVMGHEVVADVVALGPGARGLAVGQRVVLNPWLSCGPRGIQPPCPACEAGDYSLCWSFADGDLKPGIHTGVSADVTGGYAELMPAHDSMLFAVPERVPDEMAVFADPFSVSLHAITRHPPPRSGRALVYGAGSLGLCAVAILRALYPEVAVAVVARFDAQAELARRFGAAKVVAHEPRTAVIEELVGWGGGRLRRPLLGLPMAHPGAVDVVYDTVGKPETLEVAVRLLRSRGTLVKAGVHAPGRWEDSPLYFKEIALVGSNAFGVEEVDGQRRHAIAHYLDLAAAGRVDLRPMLTHTFTLDRWRDAFHALADQGRTGAVKVAFDQR

SEQ ID NO: 5650 - protein, 217 aa, Mycobacterium paratuberculosis
MKFVDDPEQAVLDAAKDMLRRGLVEGTAGNISARRSDGNIVITPSSVDYRDMQLDDLVLIDPAGSVLQAAQGRSPSTEMQLHLACFAAFDDIGCVIHSHPVWATMFAIAHQSIPACIDEFAVYCGGDVRCADYAASGTPDVGANAVKALQGRGAALIANHGLVAVGPRPDKVLHITALVERTAQIVWGARALGGPVPIPADVNRNFAAVYGYLRANP

SEQ ID NO: 5651 - protein, 327 aa, Mycobacterium paratuberculosis
VTSKPRALVTAPLRGPGLDKLRVLAEVVYDPWIEQRPLRIYSAEQLAERIAAEEAEIVVVVESDSVRGPVFELGVRAIAATRGDPNNVDIDGATAAGIPVLNTPGRNADAVAEMTVALLLAATRHLLPADADVRGGNIFRDGSIPYQRFRGGEIAGLTAGLVGLGAVGRATRWRLSGLGLRVIAHDPYHPEARHGLDELLAESDVVSLHAPVTDETTGMIGAEQFAAMRDGVVFLNTARAQLHDTDALVEALRAGKVAAAGLDHFVGEWLPTDHPLVGMPNVVLTPHIGGATWNTEARQAQLVADDLEALLAGATPAHIVNPEVLAR

SEQ ID NO: 5652 - protein, 451 aa, Mycobacterium paratuberculosis
VSRKDVTIGIDVGSTAVKALAADADGRVMARVRIPHELRIPAPDRLEHDAEAAWRRGPSAALDELLHQPGVAAVAVAAMVPSMTAVDGSGTPITPGLLYGDGRGRTPGGPQNQPLPALGEAAEFLRWTAARAPGAAGYWPAPAVANHALAGQAVIDVATAATAFPLFDGTGWDAAACAERGARVEQMPRVHSMGAVVGQLPGGAALATGAIDALCEQLVAGADRDGDVLVMCGTTLIVWATISQARQMPGLWTIPHTTPGKSQIGGASNAGGLFLGWVDRVVAQADPASAQPGRVPVFAPYLRGERSPFHDPDRRGVLEALDLTHDAAALRRAAYEASGFVVRQLIELSGAPVSRIVATGGGTRVGPWLQAIADATGHPVEVSAVAEGAALGAAFLARMAAGLETTLTDAARWVRTERVVEPDPAWAAPVQDRYQRFLELGNRPCPAVVAR

SEQ ID NO: 5653 - protein, 221 aa, Mycobacterium paratuberculosis
MTDQDRKAARREIADALLKALERRHEIADVVVESENKAAAVEAIVRLLDTSHLAAEAVMGMSFDQLTIDSRRKILAELEDLNKQLSFTVGERPASSGETLELRPFSATEDRDIFAARTQDMGSAGDGSGGPAGDLDDEIRAATARLDDEEAAWFVAVDSGQKVGMVFGELLNGEVNVRIWIHPDFRKRGYGTAALRKSRTEMAWCFPAVPLVVRAPAAKPA

SEQ ID NO: 5654 - protein, 303 aa, Mycobacterium paratuberculosis
MTRTDQDSWDLASSVGATATMVAAARALASTGERPIINDPFAAPLVRAVGLDFFRRLVDGEVAPADPQRGERDLQLETDSIAVRTRFFDDFFTGAARDGIRQSVILAAGLDARAYRLDWPAGAVVYEVDQPKVVEFKTNTMAALDARPAAQLRTVSIDLREDWPEALRANGFDVTQPTSWSAEGLLMYLPPEAQDRLFDNITALSAPGSRLATEYHPDATGTTMAQRAQEFNDRWARVGCDIDLSGLFFDGERSNVVEYLTGRGWRVSARPRRDLFDDYGLAYPEDDETAQFPNIVAVSAELG

SEQ ID NO: 5655 - protein, 441 aa, Mycobacterium paratuberculosis
LLSAFISSLRTVDLRRKILFTLGIVVLYRVGAALPSPGVNYPNVQQCIKEASGGAAGQIYSLINLFSGGALLKLTVFAVGVMPYITASIIVQLLTVVIPRFEELRKEGQSGQAKMTQYTRYLAIALAILQATSIVALAANGGLLQGCSLDIIADQSIFTLVVIVLVMTAGAALVMWMGELITERGIGNGMSLLIFVGIAARIPAEGKTILDSRGGMIFAAVLVAALIIIVGVVFVEQGQRRIPVQYAKRMVGRRMYGGTSTYLPLKVNQAGVIPVIFASSLIYIPHLITQLIRSGSGGVGNSWWDKFVGSYLSDPSDPVYIGIYFGLIIFFTYFYVSITFNPDERADEMKKFGGFIPGIRPGKPTADYLRYVLSRITLPGSIYLGAISVLPNLFLQIGNGGAVQNLPFGGTAVLIMIGVGLDTVKQIESQLMQRNYEGFLK

SEQ ID NO: 5656 - protein, 181 aa, Mycobacterium paratuberculosis
VRVVLLGPPGAGKGTQAQKLSEKLGIPQISTGELFRSNIENGTKLGLEAKRYLDAGDLVPAELTNQLVDDRLSEPDAANGFILDGFPRSLQQAKALHEMLERRGTDIDAVLEFRVSQDELLARLKARGRADDTDEVILNRMKVYRDETAPLLDYYRDQLKTVDAVGTLDEVFARALCALGK

SEQ ID NO: 5657 - protein, 266 aa, Mycobacterium paratuberculosis
MNALARLRGRKVVPQRSDGELDAMAAAGAVVAAALQAVRAAAVAGVSTLSLDQIAESVIRDAGAVPSFLGYHGYPASICASVNDRVVHGIPSAAEVLAPGDLVSIDCGAVLDGWHGDAAITFGVGALDPADEALCQGTRESLEAGIAAMVPGNRLTDVSHAIELGTRAAETRHGRAFGIVEGYGGHGIGRQMHMDPFLPNEGSPGRGPLLAPGSVLAIEPMLTLGTGKTVVLDDQWTVITTDGSRAAHWEHTVAVTDAGPRILTIG

SEQ ID NO: 5658 - protein, 181 aa, Mycobacterium paratuberculosis
VARVVGISRASGTAEAALMKALYDEHAAVLWRYALRLTGDASQSEDVVQETLLRAWQHPEVIGDTERSARAWLFTVARNMIIDDRRSARFRNVVGSTDTAGAPEQSTPDEVNAALDRLLIADAMAQLSAEHRAVIERSYYRGWTTAQIATDLGIAEGTVKSRLHYAVRALRLTLQELGVTR

SEQ ID NO: 5659 - protein, 236 aa, Mycobacterium paratuberculosis
MRTPVHDVGPPEDRYAMWDAAYVLGSLSAAQRREFEQHMAHCRGCREAVADISGVPALLSRLDHDEVAAIDEAGPAPQLSADLLPSLLTAVRRRRRRGRVATWVASAAAAAVLAIGVFVGLEGWSSTPARQVTASAEPMAQVGTTLLTSTVQVSGQHWGTSINLRCVCLAPLNAHHDTLAMVVVGRDGSRTRLATWVAVPGHTASPAGSISTPVDQIAAVQVVAADSGQVLLQRSL

SEQ ID NO: 5660 - protein, 413 aa, Mycobacterium paratuberculosis
VVGDARPLRVLVVGAGVAGISVARGLLRDGHDVTVFESRPRLAAAGGAVTVWSNGETVLRQLGVEMDGAGRQLSSVRAVTSTGRPLATLDVTAMARRLGAPVRMVPRRVLLERLLDGFPPGRIHCDRRAVALATSRDGVSVEFTDGTVAEGDVLIGADGLHSMVREWVGARHAKATGWCSWQGLVSLPEIAESDAALMMIGGGGNLGLWPAGGAEVQWWFDLPWSAGFVRPQHPIETIRSHFAGWSEPVDRVLAILTDEDLAASPFPHFRHPIPRPGQGRVTLLGDAAHTMPPTLAQGTNQALLDTMVLCQALADFGRGTPGGQADVANALRWYEKTRRRRVRAVSWVASLPVSHGEAVLRPAALVSDRLQAAALTMFLRWTSHRRMSDHINRSLGEAINRSLGEAPKIPSRR

SEQ ID NO: 5661 - protein, 197 aa, Mycobacterium paratuberculosis
VNGPGESVRVRGDFDAPSRWLWLVKWCVLAVPHYPILIGLYLVYPLCIVVAGIAIVCTGRYPRRLFDFNVGVLRWSWRLMNYRFPMNSTDRYPPFTLAASPDYPGDLAVDYPRRLKRLAVPIKWLLAIPHVLVCWSMEPLLQVLCLTAALTLLCTGTVPPGMFDLLMGIVRWRYRVAVYVSLMRDEYPPFRMDLGSR

SEQ ID NO: 5662 - protein, 208 aa, Mycobacterium paratuberculosis
MRFRNVLFPYVYRFGQPVFDRLFYHRYRRQAMSHATGRLLMVGLGPGTDLMFLPAAVTSVAAVEPEASFRRMAARLAARHGVAVDVVAGSGESIPFPDNSFDSVHIGLVLCSVRDVAATLAEIRRVLVPGGRLVVLEHVRGDGLTGRLQDLIARPWSWLAGGCEPNRRTGAAIAAAGFDTSMLRSVPRTPVPFPCKPHLQGFAVLSPR

SEQ ID NO: 5663 - protein, 832 aa, Mycobacterium paratuberculosis
VRSGRAVTAAASRLRVFSLREIAVHRRRTTASIAVMTVSATYLVAVFGIFGSITGSVSRLADGIAGVAALEVSGITDAGFADSVLADVAAVPGVATAAPMIRTTAATPSGPVLLLGADARTAALGGALTDAVSRPVRELSATPDGVQVGPRAGYAKGQAFQLGSAPVTVTEVLAGRQFAELNGGHYVLAPLALAQRVTGRAGQLDSILITFTPGADPAAVRAAVGAAVGGRAIVAAPSSRAARAGDGVRLMNYMALLGAAVALVVGAFLIYTTMTMAITQRRPVISMLRALGGRRRAVIGDLLAEAAVLGLIGGALGCGAGILAGRMAIGRLPPAVTQGLEARVEYWLPGYAVPLALAATALTAVAAAAMAARQVYKVSPVEALAPVGASAADAVPPWLRAASGVGALALFAVAALAVPAGAPTGVLLGAVLVAELAAGFALTVPIVTATSALSRVFGSCGALAAATIRRAPRRVWATVMTVLIGVLTTVVITGTNADMIGSARAIFAPVAEADVWVSADPPDSFPTDVLPQGLSERLAALPGAARVTEGACGFAVVAGTRVLLDGFAAGSRDALFRALDDRVRAEVLAGRGVVLTQNLGRALNVRAGDRLRLQTPHGPREAAVLAVVPFFSTVIGTVGMDLAQLRAWFDRPAATTLQVTAAPGVDPRRLLADVRAAVPAPNHVYDGRAALAGLQAPLHQSMFIANAVWIIVVAVAAVALLNTLTLSVTERRREIGVLRAMGTGRRLTLRMVLAEAAGIGCVGGGLGLLLGLADQWLFSRISGDMMNFPVAFRLSPLALACTAGALGITLLGSVPPARRAARLNIIEAVSVD

SEQ ID NO: 5664 - protein, 832 aa, Mycobacterium paratuberculosis; identical to SEQ ID NO: 5663

SEQ ID NO: 5665 - protein, 601 aa, Mycobacterium paratuberculosis
VNPSAARLVSSHMLGRHRVVDHIVGHLAAIGTDHLFAVDGANIEDLYDAAHFRPELTAVLAKHEFSAAAMADGYSRSGAGLGVVAATSGGGSLNLVAGLGESLASRVPVLALVGQPAAALDGRGSFQDTSGANGSLDAGALFSAVSVFCRRVQTPDDIVSLLPQAISAARAGGPAVLLLPKDIQQARVGVGERNGHGAPGGRVAIAAQWRPPAGDPHPIAAQLRRVTGEIAIIAGEQVARDDARAELEELRALLGARVATVPDAKDVAGAPGPDGRTLGVTGVMGHRNVAEAVARSAVCLIVGTRLAVTARSGLDDALAAVRTVSIGSAPPYLACTHVHTGDLRGSLRLLIRALRGHRRPVAPAGQGGGRPTELTPPPCRGPGVRYRDAMAVLDGVLPRGADIVVDAGNTGAVAIHCLPVRRDGRFVVALGMGGMGYSFGAGIGIALGRNNSGRPGGRTVVIAGDGAFFMHGMEVHTAVQYRLPMTFVLFNNNAHAMCVTREQLFYGDRYSYNRFRPSRLGAGLAAMFPGLTSVEVGDVDGFAAAMAAALDVDGPAVVSVECAADEIPPFAPFLTTSAVKDAAVKQNSVTKEIRTNVAASA

SEQ ID NO: 5666 - protein, 215 aa, Mycobacterium paratuberculosis
MSLPALEDIGDLIDGVTRIETSPREKATPIIMDMMRSVYPHDQVFGQYCTVNDYIDCPPDDLFEYMADTRSLEEWTYSLRGFTPTDEPGLWLAHDRLGSETKIYTRTVANAQARTVDYHCAWDQGDHLWMIYLMRVVDAQTVLDKPGSVVLWTNCHHPFYDHNPYPQTAPPQRPVWVGDFWDMFGAGHLLELRNLKAIAEYRHRHGLPVTPVWMR

SEQ ID NO: 5667 - protein, 341 aa, Mycobacterium paratuberculosis
MNASTVSLIDVASYLPGEPIPADYYAQFAESDDLRDNVMFCAPKYRHHVGPDESSIDMIERAAQGLIERHGHDVIEGADVLITHTQVPDMAFYGQGGGIAHRLGMRPSWVLDLNNGGCAAFVLALNVARTLLSSGQGRTALIAIAQNAAGQFFDQPTIRRKAQAAVPGDGAAVGLVTVGDSSPVLDVECRSYGEYAGEMTLSYDPPRKWWQAGPGEGSIGFTDSKITKVLARGNRQVPEVALAVCDRIGLPAKDIDLLVTNQPNRAFLRNWRDALELPPARHLDTFDECGNLFGAGIPVNLDRAISEQRIKAGDVVMMAAFAHAGDFAGAAAVRWGGRGGC

SEQ ID NO: 5668 - protein, 352 aa, Mycobacterium paratuberculosis
MLTVPRPAAGGIGEALPDAVDPFALSLNENPFPPLPAVRAALIRSVCTANRYPEFLPERLRGVIAEHIGVPAELVVLGAGATGVMLQVLQALTAPGDAIAMATPTFDGYPIVARMARLNTIAVALDEHGQHDLDGLADAAARARVVVLCRPHNPTGTVEPAAAVFRFLRRVPRDTVVLLDEAYVEFTAPEHRIDVAALVACFPNVVVVRTFSKAYGLAGLRIGYGVASPRLARPLWDQQLPFGIAITSLLAVTASYRAEDELSRRIRSITAERRRLRMRLSALGVYTTNAHANFVYLPPDPQGRAWQRVFARGGVRARYYPDGAARLTVGSRASTVAVLSAVGKATLERQVR

SEQ ID NO: 5669 - protein, 168 aa, Mycobacterium paratuberculosis
VADSRPHERDPIAAARANWERAGWGDVAPGMVAVTSVMRAHQILLARVETALRPYDMSFSRYELLRLLAFSRTGALPITKASDRLQVHVTSVTHAIRRLEADGLVQRVPHPTDGRTTLVQITELGRSTVEDATVTLNKQVFADIGMSDTESRQLASSIETLRRNAGDF

SEQ ID NO: 5670 - protein, 295 aa, Mycobacterium paratuberculosis
MTERVVVAFLGLGNMGAPMAANLVAAQHAVRGFDPVPAALSAATASGVTGFDTATDAVTGADVVITMLPNGEVVKRCYAEILPAARPGALFIDSSTISVADAREVHAQAQSHGVAQLDAPVSGGVKGAVAGTLAFMVGGEPEALERARPVLEPMAGKIIHCGAAGAGQAAKVCNNMVLAVQQIAIGEAFILAEKLGLSAQSLFDVITGATGNCWAVHTNCPVPGPVPTSPANNDFKPGFAASLMNKDLGLAMDAVTSTGAAAPLGRHAAEIYAKFAASHGDKDFSAVIEMLRGAC

SEQ ID NO: 5671 - protein, 386 aa, Mycobacterium paratuberculosis
MFTLDDDERVIAETAAAFAAKRLAPHALEWDAAEHFPVDVLRESAELGMAAIYCREDVGGSGLRRLDGVRIFEQLAIADPTTAAFLSIHNMCAWMIDSYGTPEQRKAWVPRLAAMDVIASYCLTEPGAGSDAAALSTRAVRQGGDYVLDGVKQFISGAGASDVYLVMARTGGEGPRGISAFVVEKGSAGLSFGSPEEKMGWHAQPTAQVILEGVRVPADAMLGGAEGEGAGFGIAMNGLNGGRLNIAACSLGGAQAAFDKAGAYVRDRQAFGSPLLDEPTIRFALADMATGLETSRMMLWRAAGALDADDPDKVELCAMAKRYVTDTCFEVADKALQLHGGYGYLREYGLEKIVRDLRVHRILEGTNEIMRVVIGRAEAARFRATA

SEQ ID NO: 5672 - protein, 506 aa, Mycobacterium paratuberculosis
MTTQIPHFIDGQRTAGQSTRTADVFDPSTGAVQAQVPMAGRADIDAAVASAIEAQKGWAATNPQRRARVLMRFIELVNQHNDELAELLSREHGKTLADAKGDIQRGIEVIEFCVGIPHLLKGEYSEGAGPGIDVYSLRQPLGVVAGITPFNFPAMIPLWKAGPALACGNAFVLKPSERDPSVPVRLAELFVEAGLPPGVFQVVHGDKEAVDAILNHPDIQAVGFVGSSDIAQYIYAGAAATGKRSQCFGGAKNHMIVMPDADLDQAVDALIGAGYGSAGERCMAISVAVPVGDKTADRLRARLVERINNLRVGHSLDPKADYGPLVTGAAVARVRDYIDQGVAAGAEIVVDGRERRSDDLTFGDANLEGGFFIGPTLFDHVTPDMSIYTDEIFGPVLCIVRAQNYEEALRLPSEHEYGNGVAVFTRDGDAARDFVSRVQVGMVGVNVPIPVPVAYHTFGGWKRSGFGDLNQHGPASIQFYTKVKTVTSRWPSGIKDGAEFVIPTMD

SEQ ID NO: 5673 - protein, 474 aa, Mycobacterium paratuberculosis
MHTIEADYLVVGAGAMGMAFIDTLVTETAASQARVVVVDRHHAPGGHWTMAYPFVRLHQPSAFYGVNSLRLGGDSIDQIGWNRGLYELATADEICAYYDRVMRTRLLPTGRVRYFPDSEYRGDGRFRTSAGADHTVEVTRRIVDATYMHVSVPAMRPPPYTVGDGVDCVPPNELPRRPGYQRYVVVGAGKTGIDTCLWLLGRGVEPDRLTWIMPRDSWLLDRATMQPGALFAEQIKHSFTAQLRAINDAGSVAELFSRLEDAGLLLRIDPAVRPTMYRCATVTRLELEQLRRITDVVRLGHVRSIEPGAMVLDGGAVAVDGRALYLDCTADGAEKRPATPIFTPGRITLQSVRGCQQIFSAALIAHVEAGYGDDARRNELCVPLPHPDTDVDWLRLALADYTNQLRWFDDPELMTWLSGARLDLSGHLIGHLLPSASAKPRVRARILGIAKSVFAATAARLGELLAADAALAAS

SEQ ID NO: 5674 - protein, 179 aa, Mycobacterium paratuberculosis
VAAHNEPVGPRPLRAVPEGGYPDWEAVYADNAAWVYRTLFARVGNRADAEDLTAEVFLAALRPLRLTASAAEVRAYLRATARTVLAAHWRETLGREITSIEDIEQPPEHPDAISTAPQRVARVLDSLPDRYRRILESRFLQGNSIKEAAAELGISVANAKVLQHRALRLAAQVNEGGRP

SEQ ID NO: 5675 - protein, 235 aa, Mycobacterium paratuberculosis
MNARGLRRYVDDLLRGRRPRPFLPDDFEAAQLRTAIELRAARPDSEVADAPRPEFLADLHRRLAEQMSGAPTRPRPGRGSTRRQVIVGTSAAATAAVAAVSIDRTVIAGQSGPDRAPQIASGTLAPNQGSWQRVAASSEVPDGVLRAFDLGAVSGFVRRVDGKVQAISGVCTHQGCKLWFDAPDDTLRCPCHTTSFSPSGKVLTHQLPIEPKPLPALMVREADGIIEVFAPVRRI

SEQ ID NO: 5676 - protein, 130 aa, Mycobacterium paratuberculosis
VGMTLAKSLTAALAVAVAVAACSAPRPAAGGGTPSTQTPVTAPPAAAGPNQVVIDGFAFAPATLTVPAGTTVTWINRDEEPHTVAASDGSFHSPGMGTGAVFTHTFSAAGTFDYVCSIHPMMRGTVVVTG

SEQ ID NO: 5677 - protein, 306 aa, Mycobacterium paratuberculosis
MNPNMSRRQLIRHTAWFGAAVGFALTGGEVISHVAGRAAAQHTRAQPTLRFAQISDSHLGFTGAPNPDVAGTFGRAIDQVNNLGYTPDFVIHTGDLTHLSTPEQFDQAKQMMSALKTPHVFTVPGEHDSVDDAGQKYRSVFGAGSAGDGWYSLDVAGVHLIALVNTLNLRKLGHLGADQLEFVKKDVAGLSSDTPIIVFSHIPLFAMYPQWGWGTDDAAQALSYLRRFASVTCLNGHVHQLFSKTEDNVTFHSGTTTAYPLPHPGDRPAPKPVTLPAGRLRDALGVREVAYSRGDTVLALKERTLQ

SEQ ID NO: 5678 - protein, 441 aa, Mycobacterium paratuberculosis
MTLGPVFDPRRNALNAWRLLLAAEVMLWHCWPITNRLPPAATLQLLFSVGVDGFFAISGFLITRSWLDDPRLRDFLAARALRILPGYYVCLIVTAFAVAPLSVAIQGGSVGALLSSGAPLEYLAKNSAVAYVHLNIGATPGGVPHPGVWNGSLWSLVWEVACYLAVAAIGVAGLADRRWMSVAVLALAVVGAALVPPLTYPGQWTVAQLAVRSAIMFAAGAVVYQWKDVIPARWSLVAVCVVVVAAASRLPDYRVVAALPLAYAIIVSGALLRNRRLRLATDLSYGVYIYAFPVQQLLAVCGLAPAAGGGVLPDRPGRHPAAGRGQLVVDRKAVDGAQTPAAPEVVCGHHRRTRTSGNHSSTVSTSAATLIAAYGAGSQPRSAKPNSPTVRDAANAASEPPATAAPAQLSQPGPPAQISSATANDTLACTRNATPMPGMCW

SEQ ID NO: 5679 - protein, 381 aa, Mycobacterium paratuberculosis
MKLGQVFDPRRNALNALRLVLAAEVMLFHSWPITGHMPPKSILQLFFSVGVDGFFAISGFLITRSWLSDPRLRDYLTARALRILPGFYICLIVTAFVFAPLSVVIQGGSPAKLLGSAAPLEYILKNSAIVYLQPSIDGTLHGVPGGNAWNGSMWSLIWELLCYLVVAAIGVVGLGNRRWISPLILVLATLGALVVPPLTFPGVWTIPQLAVRSAIMFSAGAVMYQWRDVIPARWSLVAVALAIVAAAGFLPDYRVVGALPLAYAVIVTGSLLKSERLVLRTDLSYGVYIYAFPTQQLLAVCGLATRLHPALFFLASVAATLPLAAASWFLIEKPSMALKRRLKRKWTGPRAAESDPRVSQAEPAPADVLADRPAPEAPGHF

SEQ ID NO: 5680 - protein, 374 aa, Mycobacterium paratuberculosis
MKLGQVFDPRSNALNAWRLALAAEVIFWHTFPIRGHLPSVRAVLQLLLCVGVDGFFAISGFLITASWLSNPQLRAYLAARALRILPGFYVCMIVTAFVFAPLSVAIQGGSPARLLFSYAPFEYVLKNIAVLWLKPDVGGTPHDIPNAGIWNASLWSLFWEVMCYLVVAAIGVAGLANRRWVSPVILVAAAIGASFLPPVTFPEVFHHPEGNVATALVFLACRAAIMFSAGALLYQWRDVIPARWSLVAVCVVIVLVAGQLPDYRVVAALPLAYAVVVSGSLLHNRRLWFRTDLSYGMYIYAYPVQQLLAVLGLLSLNPVVFCLAVAAATVPLAAASWFLVEKPARALKTRLKRKAAATPEQAAMVLPPEVPGVA

SEQ ID NO: 5681 - protein, 201 aa, Mycobacterium paratuberculosis
VSARELKVPGAWEITPTVHGDARGHFFEWLTDKGFRSFAGHRLDVRQANCSVSAAGVLRGLHFAQVPLSQAKYVTCVRGSVFDVVVDIRVGSPTFGQWDSVLLDDAEHRTIYISEGLGHGFLALQDNSTVMYLCSAEYNPGREHTICATDPALGIDWPLVAGAAPTLSERDAAAPSLEEVRASGLLPTWAETQAFIEGLPR

SEQ ID NO: 5682 - protein, 331 aa, Mycobacterium paratuberculosis
MRLLVTGGAGFIGANFVHSTVREHPEDSVTVLDALTYAGRRESLAGVEDSIRLVVGDITDAELVSRLVAESDAVVHFAAESHVDNALAGPEPFLHTNVVGTFTILEAVRRHGVRLHHISTDEVYGDLELDDPNRFTESTPYNPSSPYSATKAAADMLVRAWVRSYGVRATISNCSNNYGPYQHVEKFIPRQITNVLTGRRPKLYGTGANVRDWIHVDDHNSAVRRILESGEIGRTYLISSEGERDNLTVLRTLLQMMGRDPDDFDHVTDRVGHDLRYAIDPSTLYDELCWAPKHTDFEEGLRETIDWYRANESWWRPLKDASEARYEERGQ

SEQ ID NO: 5683 - protein, 288 aa, Mycobacterium paratuberculosis
MTEGVSLKPDLGPFGVWLSTRSITAELAARIKSLGYGAAWIGGSPDAELSWVDPALAGTTSLHLATGIVNIWSAPAAAVAESFHRIESGHPGRFLLGIGAGHREHTREYVKPYDAVVSYLDELDAAVIPTSRRVLAALGPRMLRLAAQRSAGAHPFLTTPEHTAKARELVGGSVFLAPAHKVVLTTDRDRARAAGRQAIEHNLGLSNYVHNWLRLGFTEADVRPPGSDRLIDAVISYGTPQAVAARLREHLDAGADHVAIQVLGGDSEETLLPALTELADALGLTRTN

SEQ ID NO: 5684 - protein, 282 aa, Mycobacterium paratuberculosis
MTQAAGKPDLGRFGSFGRGVTPQQAKDIEALGYGAVWVGGSPPAELAWVEPLLEATTTLQVATGIVNIWTAPAGPVAESFHRIEAAYPGRFLLGIGVGHPEAHTEYRKPYDALADYLTRLDEYGVPGGRRVVAALGPRVLKLSAERSAGAHPYLTTPEHTARARELIGPSAFLAPEHKVVLTTDAEHARAVGRKALDIYFNLANYRNNWKRLGFTDDEITRPGSDRLVDALVAYGSVDRIAARLREHLDAGADHVPVQVLTKDENLVSALAELAGPLGLKPS

SEQ ID NO: 5685 - protein, 73 aa, Mycobacterium paratuberculosis
MAKKDGAIEVEGRVVEPLPNAMFRIELENGHKVLAHISGKMRQHYIRILPEDRVVVELSPYDLSRGRIVYRYK

SEQ ID NO: 5686 - protein, 37 aa, Mycobacterium paratuberculosis
VKVNPSVKPICDKCRVIRRHGRVMVICSDPRHKQRQG

SEQ ID NO: 5687 - protein, 124 aa, Mycobacterium paratuberculosis
MARLVGVDLPRDKRMEIALTYIYGVGRTRSNEILAATGIDRDLRTRDLTDDQLTHLRDYIEANLKVEGDLRREVQADIRRKIEIGCYQGLRHRRGLPVRGQRTKTNARTRKGPKRTIAGKKKAR

SEQ ID NO: 5688 - protein, 138 aa, Mycobacterium paratuberculosis
MPPAKKAAAAPKKGQKTRRREKKNVPHGAAHIKSTFNNTIVTITDPQGNVIAWASSGHVGFKGSRKSTPFAAQLAAENAARKAQEHGVRKVDVFVKGPGSGRETAIRSLQAAGLEVGAISDVTPQPHNGVRPPKRRRV

SEQ ID NO: 5689 - protein, 201 aa, Mycobacterium paratuberculosis
MARYTGPVTRKSRRLRTDLVGGDQAFEKRPYPPGQHGRARIKESEYLLQLQEKQKARFTYGVMEKQFRRYYEEAVRQPGKTGEELLRILESRLDNVVYRAGLARTRRMARQLVTHGHFTVNGVRVDVPSYRVSQYDIIDVREQSLNSVPFQIARETAGDRPVPSWLQVVGERQRILIHQLPERAQIDVPLTEQLIVEFYSK

SEQ ID NO: 5690 - protein, 347 aa, Mycobacterium paratuberculosis
MLISQRPTLSEEVLTDNRSQFVIEPLEPGFGYTLGNSLRRTLLSSIPGAAVTSIRIDGVLHEFTTVPGVKEDVTAIILNLKSLVVSSEEDEPVTMYLRKQGPGEVTAGDIVPPAGVTVHNPELHIATLNDKGKLEVELVVERGRGYVPAVQNRASGAEIGRIPVDSIYSPVLKVTYKVDATRVEQRTDFDKLILDVETKSSITPRDALASAGKTLVELFGLARELNVEAEGIEIGPSPAEADHIASFALPIDDLDLTVRSYNCLKREGVHTVGELVSRTESDLLDIRNFGQKSIDEVKVKLHQLGLSLKDSPPSFDPSQVAGYDVATGTWSTEAAYDDQDYAETEQL

SEQ ID NO: 5691 - protein, 186 aa, Mycobacterium paratuberculosis
MPKPTKGPRLGGSSSHQKALLANLATSLFEHGRIKTTEPKARALRPYAEKLITHAKKGALHNRREVLKKIRDKDVVHVLFEEIGPFFADRNGGYTRIIKVEPRKGDNSPMAVIELVREKTVTSEADRARRVKASKKAPEAAAAAPQAAVEPEAAEAAPAPDAPEAAPEAEAAAPRPADEAEGSSED

SEQ ID NO: 5692 - protein, 251 aa, Mycobacterium paratuberculosis
VAGVLDEALTTVFRTPVRLRAAGRTDAGVHATGQVAHLDVPGTALPNAYPRAPHVGEAEFGPLLRRLGRFLPTDVRVVDITRAPAGFDARFSALRRHYVYRLSTAPWGVLPQQARYVTAWPRPLDVEAMAAASRDLLGLHDFAAFCRHRENATTIRDLQRLDWTRDGDLITARVSADAFCWSMVRSLVGALLAVGENRRPVSWCRELLSATNRSSDYATAPAHGLTLVGVDYPPDDQLAARNLITRDVRSR

SEQ ID NO: 5693 - protein, 211 aa, Mycobacterium paratuberculosis
VRLIPVGLGVGLLAGAAVLIAPQLIPLASASCPGVEVVFARGTDEPPGVGKVGGAFVSSLREQTRKSVGAYGVNYPANKDFLAAADGANDASNHIQQMAGNCPNTKLVLGGYSQGAAVIDIVTAAPVPGLGFRNPLPPQAADHVAAVALFGNPSGRAGRLMSALTPDFSGKTIDLCNPGDPICSGGYQWASHLSYVPGLTNQAARFVATRV

SEQ ID NO: 5694 - protein, 289 aa, Mycobacterium paratuberculosis
VKTHRIGRLLGLGSSALITAAGLLGAPAAVPVASADDCPDVEVIFARGTNEPPGMGRVGDAFVESLRQQTSGLNIDTYGVNYAASKLQLHGGDGANDTINRIKQAVQKCPNTKIVLGGYSQGASVMDIVAGVPIGGINWGSSITPDLASHVAAVATFGDVADRAGGTLPSQSALLGSKAIDLCNPNDPICHAGPGNEWSGHTEGYVPVYTTQAAAFVASKLMGAGQSVPGYGPSVPGVGPQSPGYGQQSPVYGQTPPGSGPSIHDNAPGPGTAPAPAVPSTPPSQAPLV

SEQ ID NO: 5695 - protein, 477 aa, Mycobacterium paratuberculosis
VDNRFGGAARRPSVCATDSRGRGAVPRRPTTWLQVSAYRYLSRRLECALLGQDPAAAGMRARGQPAALLAGAVLTAAALAAATLLGLLRPHVALDGARVVLARDSGALFVRVGDTWHPVLNLASARLIAASAVDPLTIRQADLDGSKRGPLLGIPGAPAFLGRPLAAAESLCDSDGAGATTILLGRTDAASMRVLGGGQAMLVAAAAGSPAYLLHDGHRARVDLADAAVVRTLRLEGRAPRLVSQSLLDAVPEAAPIAVPRIPGLGGAAPGLPGFAIGTVLRIIRADGDEYYAVLAGGVQRIGRVAADLLRLSNPQGSADAVTVAPDALRTAPVVAALPVAGFPDRAPTVSEPAATICAGWGDARSVAFLTGAAVPVPPGRAPVTLAQADGRGPALDAVYLPPGRSAYVRAGANAGTRYLITDTGVRFAVPDDDAAADLGLGQPSPAPWPLLTLLPAGPELSRPNASVARDTVVGAP

SEQ ID NO: 5696 - protein, 432 aa, Mycobacterium paratuberculosis
VRVVRLLAVSALTMLPVFETPPAHAVSPPAVEDKWLPKPARPAPPWPTAQREVCATLTADSGPGPRGPAGGSDLSAVWQLSRGAGQRIAVIDTGVARHRRLPGVVPGGDYVSTGDGIQDCDAHGTLVAGIIAAAADPKSDEFSGIAPEATLISIRQSSAKFGPAGNRSGGGVGDVDTLAQAVRTAADLGASVINISSVACAPVASAPDDRALGAALAYAVDVKNAVVVAAAGNTGGAGQCPPQQPDATWQTITVAVSPAWYDDYVLTVGSVNADGAPSAFSLAGPWVDVAAPGEAVTSLAPEPVSGTSYAAPVVSGLAALIRARFPALTARQVMQRIEATAHHPPAGWDPLVGHGTVDPLAAVSAETGAPPPAPRAAPVPIAAPPPAPARDSRARDVAVRGAAFCLVALTLAAAAGAVRARLRRTHDGVAGD

SEQ ID NO: 5697 - protein, 452 aa, Mycobacterium paratuberculosis
LAVSTTGLCRVSVHWETQAVDVSLPAEIAVAELIPSLVDMLGAGDGGAGRYRLSAAGAAALDPSTTLAHNHIGDGAILVLSRIDVPLPAPRYRDIADTVSAALDATARPGVAVRRVAGAAAAASFVTAGGLLLVRNTFSAGVVRDSGGTVAVLVSTTLLTLGAAAVAHRGYRDRGAALALGAIATVFAGLAGFVAVPGAPSLSHVLLAAAAAGLAAVSAIGLSGCCGAGLLALACWCLILATAALAGVLSGAPLPTVASAAGLVSLCLLGMAARASLALAGLSPRPATATAGGPEPGEAWVSARARRADRWLTGLLAGLSSSATVAAAVTVLAGAPRLCCLAFGTGTGALLLLRSRGGDGTRALVFAAGAIVTTATTFGVAAWSAPLPGPWVAATTATLVAAALYLGCAARTCSPVLSRAADLLEWLALAALVPLTCWIAGLYGTVRGLTLG

SEQ ID NO: 5698 - protein, 1214 aa, Mycobacterium paratuberculosis
LPPIPVLPTVVGREGMRDDPGRHRCRGSAGTAGPESAGLPARLLPVALSVAGMGVMTVVFASGGAAARQPAFLAFPATMLVSTVAAALIGRSRRGGGGLDADRGRYLEYLNQLARSVSEIAAAQCASALRDHPDPDTLWTLIGGPRMWRRRPTDPDFCVVRVGMGVLPLARRVVAPPVPAEEVRDPVTATALRRFLHTHATVPGPVTVDLGAGSPVTIDGDGGAARAVLRAVVCQLAVLHAPDRLGIAAVVGDGDRAHWDWLKWLPHNRHPTHYDALGPMRMVYSTAAQAQQALAGLPVARLVLVAERAVAPIAGATVIAIGAGDDGAPVTIRTAAGTVSPSRPDRMTAADALTCARRLAGQRVTAGDDDGGWPGLVGLADVSGFDPATLWGRQTGRDRLRAPLGVAADGTPVELDIKEPAEHGMGPHGLCVGATGSGKSELLRTIALGMMARNSPDVLNLLLVDFKGGATFLDYANARHVAAVITNLADDAPLVDRMRAALAGEMNRRQEALRTAGCDSVAAYQHARRSAAALPALPALFVIVDEFSELLSQQPDFADTFVAIGRLGRSLGIHLLLASQRLDEGRLRGLDAHLSYRLCLKTLSEAESRAVLGDLDAYHLPADPGAGYLRVGAGEPIRFQAALVSGPLRPDTAPRPPAMVRVFGTRVVGPVSRPVEAAHPSGRSISAAVLDRLAGHGPAAHRVWLPPLGRPPELCTLLGGAADLTVPVGLVDRPFEQCRTPLIVDLSGAAGNVAVVGAPRSGKSTALRTSITALAATHDPARVQFYCLDFGGGALSSLHTLPHVGAVAGRAEPRRVGRIVAECEAVVRRREAFFGEHAIASIADYRQRRPGSDPFGDVFLVIDGWAVLRRDFETLEASIIALAGQGLSFGVHLVLSASRWADIRPALRDQIGTRIELRLGDPADSEIDRRAAAHVPRDSPGRGLSHDGLHMVIASPVADVAAGESVAPPIPLLPARVDLDAVRRGSGDEFAGRPLLGLQERQLQPVAIDFARESHLLILGANGCGKTAALRTLCRELVRTNTAAQAQLVIVDFRRALLGIVESEQLHGYAMSPAALTALLPGLLDLLSGRMPPPDASQAQLRAGSWWSGPDVYVVVDDYDLVASPSGNLLAPLVGFLPYASELGLHLIIARRSGGAERAMFEPLLAGLRDLGCMSLTMSEAAPFAAAPPLPPGRGVLTTRAGADELVQVAWSPP

SEQ ID NO: 5699 - protein, 405 aa, Mycobacterium paratuberculosis
VSPHRAVVETGPATIRRLCCGTRMPADREVIEAALDAIDDPVALVGERPVAVEALWKTALRSACCACDGAVVVYPSWWPPARVRTVSAAAATLAGEARARPRSWLLARASRAAPEGTVVVEVAERVVAICGPAPASVTAVPRTAPPRSVADGVARAVASLAPAVVLIDLPDPIAGAAELGPLIADALRGRIRAEMVHINDIRLARLACSASDGDDAPAGPDRSAAAPARSRPRILSGLGAAAVIAAAAAPLAITAAPDRARPMPGTSLVEGRVALSVPNDWPTQRLVGGPGSARVQVTSPTDPEVALHITQSPVVGETLGDTARRLKQAIDAAPAGVFVDFDPTATSVGRPAVTYREIRPAHQVRWTVLLDGPVRISIGCQSRPGAEQAVREACELAVGSAHAIG

SEQ ID NO: 5700 - protein, 105 aa, Mycobacterium paratuberculosis
MATSNTVSTDFDLMRSVAGTTDARNEEIRAMLQAFIGRMSGVPPAAWGGLAAARFKEMIDRWNAESVRLYHALHAIADTIRHNAATLQDAGQNHADHIAAAGGSL

SEQ ID NO: 5701 - protein, 98 aa, Mycobacterium paratuberculosis
VDPTLSYNFGEIEHSVRQEIHTTSARFNAALDELRARIAPLQQLWTSEAATAYQAEQLKWHRSATALNEILVQLGDAVRDGAEEVADADRRAAGVWAR

SEQ ID NO: 5702 - protein, 147 aa, Mycobacterium paratuberculosis
VPTYAPKAGDTTRSWYVIDATDVVLGRLAVAAANLLRGKHKPTFAPNVDGGDFVIVVNADKVAFSGQKLDKKLAYRHSGYPGGLRSRTIGELMQKHPDRVVADAIVGMLPKNKLSRQIQRKLRVYAGPEHPHTAQQPIPYEIKQVAQ

SEQ ID NO: 5703 - protein, 166 aa, Mycobacterium paratuberculosis
VTETTEALENPDNPEAETAAAEVTEAPVEAVPAESYVFERPIQTVGRRKEAVVRVRLVPGTGKFNLNGRTLEGYFPNKVHQQLVKAPLVTVDRVDGFDIYAHLHGGGPSGQAGALRLGIARALILASPDDRPALKKAGFLTRDPRATERKKYGLKKARKAPQYSKR

SEQ ID NO: 5704 - protein, 444 aa, Mycobacterium paratuberculosis
MGRLFGTDGVRGVANRELTAELALALGAAAARQLASGSAPGRRVAVIGRDPRASGEMLEAAVIAGLTSQGVDALRVGVLPTPAVAYLTGAYDADFGVMISASHNPMPDNGIKIFGPGGHKLDDGTEDRIEALVGDAGPRPVGAGIGRVIDAEDAADRYLRHLSKASTLRLDGLTVVVDCAHGAASAVAPRAYRAAGARVIAINADPNGLNINDNCGSTHLDSLRAAVVAHRADLGLAHDGDADRCLAVDADGNLVDGDHIMVVLALAMREAGELASDTLVTTVMSNLGLHLAMRSAGITVRTTGVGDRYVVEELRAGDFSLGGEQSGHIVMPALGSTGDGIVTGLRLMTRMAQTGSPLSDLASAMQTLPQVLINVTVADKATAATAPSVQTAVGQAAAELGDTGRILLRPSGTEPMIRVMVEAPEKDIAQRLATRVAEAVSAAR

SEQ ID NO: 5705 - protein, 109 aa, Mycobacterium paratuberculosis
MKSLGATRPGAVARTQIDVAAAQRVANQFAVAAEFLDRAVTDHLARLAFGGAVAGRAHTERGDALHVELQRLAGQVSQWSRASGEIAAALRSSAERYADAELYAAARIA

SEQ ID NO: 5706 - protein, 164 aa, Mycobacterium paratuberculosis
MADRLDVAGRLAEGRAGVEHTQTYVQACHALGYQHPDLTAHPAQVREWYAGEDGLDLRARSTATAPSCGRRAWWQPRRCGCSAPRWPSWPWRGRVRAARRRCSCCSGTATPRRRSPPSCAPPRSGVSRCATTCGISSTPRRRRPSPWMTAPARSGRNGWPPPPR

SEQ ID NO: 5707 - protein, 461 aa, Mycobacterium paratuberculosis
LPCAGLPTSRPDGASRAGPRMVCGRGRSRPARALDRDCAELRAAGVVAAEALRLQRAQVAELAVAWTGAGGEAAVQLLQRHCDTAEALATELRAAAQRCESLRDNLWYLIDAKAATAIAVDDRTRAQRPEWLAAAAAVTAGQPDRDDAHNLIRQQVIPYVDNDIRNEWLPAMRSATDGVQTSYAMVVDRMAAAPAARFEFPGDLGSGLVPVPATRPLVAAPMPPLDAAPTLPDAAPTLPAAVSEPAAAATLPAAVPSPAAAPAADWGAALGDAAGMPAGDLGGLAGSGMGSGLGSGLGGGGGLLGLAGKIVDAMGGLLGSVGDGLDGADPFGDQDPLDDNAFHGDPFHADDPADAKDAGDDADETAADEPAAPDRPAPAGEAEPNGEPAPSGEAPPTGEPAQPVAATPPAAPPPGAPPPGAPPPAEPPADPGPAPGAAQPAPEPGSTPCQIAADQLPQAGQ

SEQ ID NO: 5708 - protein, 347 aa, Mycobacterium paratuberculosis
LMRIGIALNYSGGFHEAVDRVVELEKAGIEVAVVAEAYSFDAISQLGYLAAKTRTVELASGVLPLYIRTPSLLAMTAAGLDYVSDGRFRLGIGTSGPQVIEGFHGVPFDAPIGRTREIVEICRMVWRRERVQYAGRHYQLPLPPDRGTGLGKPLHLINHPVRERIPISIAALGPKNVELTAEIAEGWQPVFYLPDKAGSIWGEALAAGAAKRDPALGPLDVMVHASLAIGDDVDQRLAWVKPQLALYIGGMGAKGRNFYHNLATRYGFGEVADRIQELYLSGRKQQAIDLVPDELVRRMSLVGPRGYVAERMAAFAESGVTTLLLSPLAADRDEALGFVEHALQLRP

SEQ ID NO: 5709 - protein, 279 aa, Mycobacterium paratuberculosis
VARIRKLVAALHRRGPHRVLRGDLAFAGLPGVVYTPEEGLNLPGVAFGHDWLTGAARYANLLEHLASWGIVAAAPDTQRGLAPSVLNFAFDLGTALEIVSGVRLGPGKISVHPAKLGVAGHGFGASAAVFAAAGMPAKPAAVAAVFPSVTSPPAEQPAATLRVPGVILTAPGDAKTLNSNALALAEVWDAATVRVISKAEPGGLVEGRRLTKVVGLAGAHRRTQRSVRALLTGYLLYTLGGDKKYRDFADPHVQLPGTAAPDPEAGAVPLEEKIVALLK

SEQ ID NO: 5710 - protein, 89 aa, Mycobacterium paratuberculosis
LPSHQFSRRRIDFLRPAAGRHEEAIMTAIRCDDVVTATRVPAARQARPPRPAPADSGSPLMDMTTRLLAIPLHQLYALLWRVGIIEVRA

SEQ ID NO: 5711 - protein, 624 aa, Mycobacterium paratuberculosis
MCGIVGYVGQQPACAVVMAALRRMEYRGYDSSGVALVNGDGTLTVSRRAGRLANLEEAVAQLPPSALTGTTGLGHTRWATHGRPTDRNAHPHRDAAGKIAVVHNGIIENYAGLRHELEADGVEFASDTDTEVAVHLVAQAYRHGPTAGDFAASVLAVLRRLDGHFTLVFANADEPGTIVAARRSTPLVIGIGDGEMFVGSDVAAFIPHTRNAIELGQDQAVVLTADGYRITDFDGNDDLGPGAYREFHIDWDLAAAEKGGYEYFMLKEIAEQPAAVADTLLGHFVDGRIVLDEQRLSDQELREVDKVFVVACGTAYHSGLLAKYAIEHWTRLPVEVELASEFRYRDPVLDRSTLVVAISQSGETADTLEAVRHAKEQKAKVLAICNTNGSQIPRECDAVLYTRAGPEIGVASTKTFLAQITANYLVGLALAQARGTKYPDEVEREYHELEAMPDLVARVLATIKPVAALAQRFAQSPTVLFLGRHVGYPVALEGALKLKELAYMHAEGFAAGELKHGPIALIEDDLPVIVIMPSPKGSAVLHAKLLSNIREIQARGAITIVIAEEGDDTVRPYADHLIEIPSVSTLLQPLLSTIPLQVFAASVAQARGYDVDKPRNLAKSVTVE

SEQ ID NO: 5712 - protein, 299 aa, Mycobacterium paratuberculosis
MRSAGMRYGVVGLVVLVLAAYIGSVVLYAQSGTGRRIDEANPTMDGDRPSATINVEDIQSNNSVLAVNLAFNPGSALLDPKTHHLKEDLSLRVRSSAMPSRHTWTKGMLPGLMAVPLTIAGQIERWPFDQYHSGPLEVEIFYGPDTDRDPDHVPVTFVDHLSGWQLTATRPQADGPYRLHVRRSMSTAAFAIVILGVLIAIASLALFVAIQTTRDRRPFQPPMTTWYAAMLFAVVPLRNALPGSPPFGSWVDITVVIWVLVALAISMVLYIGCWWRHLNPPPAAAPAQPAQPAPATTGG

SEQ ID NO: 5713 - protein, 243 aa, Mycobacterium paratuberculosis
VGQASVRGRVRGMTRAVWHFVISAPLTYGWLLVLMITTIIQNQLTGRQLHSVLLHRSTNIHELGRDPLDVLFSSLLWIDGKNFEPYLLLFTLFLAPAEHWLGQLRWLTVGLSSHILATYISEGILYFAIEKHDASERLVHARDIGVSYFLVGVMAVLTFHIARPWRWGYLGVLFLIFGFPLLTMDRVELNFTAIGHFTSILIGLCFYPMTRAKGGRQLSPARLRAMLRRRVAPPARPDVDSGR

SEQ ID NO: 5714 - protein, 473 aa, Mycobacterium paratuberculosis
MRHYYSVDAIRAAEAPLLASLPDGALMRRAAFGLATEIAAELTARTGGVAGRRVCAVVGSGDNGGDALWAATFLRRRGAAADAILLNPERAHRKGLAAFGKAGGRIVESVSPTTDLVIDGVVGISGSGALRPAAAEVFAAVDDAGIPVVAVDIPSGIDAATGATSGPAVHAVLTVTFGGLKPVHALGDCGRVKLIDIGLDLPQTDVLGFEAADVAARWPVPGPHDDKYTQGVTGVMAGSATYPGAAVLCTGAAVAATSGMVRYAGSAHREVLAHWPEVIASPTPASAGRVQSWVVGPGLGTDDAGAAALWFALETDLPVIVDADGLTMLAAHPELVANRAAPTVLTPHAGEFARLAGSPPGDDRVGATRKLADTLGVTVLLKGNVTVIADPGGPVYLNPAGQSWAATAGSGDVLSGMIGALLASGLPAGEAAAAAAFVHARAAALSAADPGPGEAPTSSSRMVPHIRAALAAL

SEQ ID NO: 5715 - protein, 463 aa, Mycobacterium paratuberculosis
VPQHPSLPAHAIAPAYTGRLFTAPVPALRMPDESMDPDAAYRFIHDELMLDGSSRLNLATFVTTWMDPEAGRLMAETFDKNMIDKDEYPATAAIEQRCVCMVADLFHAEGLNDADPYSACGVSTIGSSEAVMLGGLAMKWRWRAKTKDWKKRTPNLVMGSNVQVVWEKFCRYFDVEPRYLPMEEGRYVITPEQVVDAVDEDTIGVVAILGTTYTGELEPVADICGALDKLALKPASAGGVDVPVHVDAASGGFVVPFLHPELKWDFRLPRVVSINVSGHKYGLTYPGVGFVVWRSKEYLPDELVFRVNYLGGDMPTFTLNFSRPGNQVVGQYYNFLRLGREGYTKVMQTLSGTARWLGEQLRVSEHCELISDGSAIPVVAFRLAKNRGYTEFDVSHELRTYGWQVPAYTMPDNATDVSVLRIVVREGLSADLARALHDDAVSALTSLDKVKPGGHYDAQHFAH

SEQ ID NO: 5716 - protein, 391 aa, Mycobacterium paratuberculosis
MAAVAVTPISLTPGVLAEALVDLGAIEHNVRLLCEQARGAQVMAVVKADGYGHGAVQTARAALAAGAAELGVATVDEALALRAAGISAPVLAWLHPPGIDFRPALLAGVQIGLSSQRQLDELLTAVRDTGRTATVTVKVDTRLNRNGVPPAQYPSMLTALRRAVAEEAIVPRGLMSHMVYADQPANPVNDVQAQRFTDMLAQAREQGVRFEVAHLSNSSATMSRPDLAFDMVRPGIAVYGLSPVPELGDMGLVPAMTVKCTVALVKSIRAGESVSYGHTWTAQRDTNLALLPVGYADGIFRSLGGRLQVSINGRRRPGVGRICMDQFVVDLGPGRPDVAEGDEAILFGPGSNGEPTAQDWADLLGTIHYEVVTSPRGRITRTYREAHTVES

SEQ ID NO: 5717 - protein, 334 aa, Mycobacterium paratuberculosis
MTQRATIEDPYADEDFNTFDGDRALVVTTPDGVPLAVREAGPPDAPLTMVFVHGFCLQMGAFHFQRTRLPEQLGPDVRMVFYDQRGHGRSGEAAPESYTLTQLGRDLQTVLQVVAPRGLVVLVGHSMGGMTVLSHARQFPEQYGRRIVGAALISSAAEGVSRSPLGEILKNPALEAVRVAARSAPKLMHRGRNVSRSLIGPVLRAASFSDLQVSRSLDAFSQRMMNSTPIPTMVGFLDALEHHDETAGLWTLLRVPTLIACGDHDLLTSDEYSRKMAASLPQSELVIVAGASHLALLDKPEAINGGLVRLVRRATPSRAALALRRIGERLWRRG

SEQ ID NO: 5718 - protein, 159 aa, Mycobacterium paratuberculosis
VAESGTATLPTAQDTAALGARLAEQLRAGDVVVLSGPLGAGKTVLAKGIAAAMDVDGPVTSPSYVLARVHPPRRPGAPTMIHVDLYRLLDHTGNQGADLLGELDSLDLDSDLDDAVVVAEWGEGLVERLAPRHLDIRLERVSGSDVRIATWRWAGGEPS

SEQ ID NO: 5719 - protein, 208 aa, Mycobacterium paratuberculosis
MSPLVLALDTSTPAVTAGIVRRDDLSVLAQRITVDARAHAERLTPNVLAALHDSGLNMTDLVAVVVGCGPGPFTGLRAGMATAAAYGHALGIPVHGVCSLDAIGGQTTGDTLVVTDARRREVYWARYRDGVRTDGPAVAAPADVDPGGAEAVAGSPEHARLFGLPVTGPAHPTPAGLVAAVGDWSVRPQPLVPLYLRRPDATPRAARP

SEQ ID NO: 5720 - protein, 156 aa, Mycobacterium paratuberculosis
MTAGGEPVTVGALTRADARRCAELEAQLFDGDDPWPAAAFHRELASAHNHYVGARVGDTLVGYAGISRLGRVPPYEYEIHTIGVDPAYQGRGIGRLMLDRLLEFADGGVVYLEVRTDNEPAIGLYRSVGFEQIGLRRRYYRISGADAYTMRRKARQ

SEQ ID NO: 5721 - protein, 341 aa, Mycobacterium paratuberculosis
VTTILAIETSCDETGVGIARLDADGAVTLLADEVASSVDEHVRFGGVVPEIASRAHLEALGPTMRRALSAAGVTKPDVVAATIGPGLAGALLVGVAAAKAYSAAWGVPFYAVNHLGGHLAADVYQHGPLPECVALLVSGGHTHLLQVRSLGDPIVELGSTVDDAAGEAYDKVARLLGLGYPGGRVLDELARTGDREAIVFPRGMTGPRDAPYAFSFSGLKTAVARYLESHPDAVNADVAAGFQEAVADVLTRKAVRAATDLGVTTLLIAGGVAANSRLRELAEQRCAAAGLTLRIPRPGLCTDNGAMIASFAAHLVAAGAPPSPLDVPTDPGLPVVKAQVS

SEQ ID NO: 5722 - protein, 100 aa, Mycobacterium paratuberculosis
VAKVNIKPLEDKILVQANEAETTTASGLVIPDTAKEKPQEGTVVAVGPGRWDDDGAKRIPLDVSEGDTVIYSKYGGTEIKYNGEEYLILSARDVLAVVSK

SEQ ID NO: 5723 - protein, 538 aa, Mycobacterium paratuberculosis
MSKIIEYDETARRAIEAGVNTLADAVRVTLGPRGRHVVLAKAFGGPAVTNDGVTVAREIDLEDPFENLGAQLVKSVATKTNDVAGDGTTTATVLAQALVKGGLRLVAAGANPIELGAGISKAADAVSEALLASATPVSGKDAIAQVATVSSRDQVLGELVGEAMTKVGVDGVVSVEESSTLNTELEFTEGVGFDKGFLSAYFVTDFDAQQAVLDDPVILLHQEKISSLPDLLPMLEKVAESGKPLLIIAEDIEGEALATLVVNSIRKTLKAVAVKAPFFGDRRKAFLEDLAIVTGGQVINPDTGLLLREVGTEVLGSARRVVVSKDDTIIVDGGGAKDAVANRIKQLRAEIEKTDSDWDREKLQERLAKLAGGVAVIKVGAATETALKERKESVEDAVAAAKAAVEEGIVAGGGSALLQARKALDELRGSLSGDQALGVDVFAEALGAPLYWIASNAGLDGAVAVHKVAELPAGHGLNAEKLSYGDLIADGVIDPVKVTRSAVLNSASVARMVLTTETAVVDKPAEEADDHGHGHHHH

SEQ ID NO: 5724 - protein, 538 aa, Mycobacterium paratuberculosis; identical to SEQ ID NO: 5723

SEQ ID NO: 5725 - protein, 102 aa, Mycobacterium paratuberculosis
MTNLDDMRRRRPGNRTRIDAIKAEMDREVAQYRLRELREAAGYTQTTLAAAIGVGQNRVSQMEHGDLGTSRVDTLRKYVEATGGELEVSVKRPDGSRVLLSL

SEQ ID NO: 5726 - protein, 134 aa, Mycobacterium paratuberculosis
VRKWEVDLTLIEAWMDALDDEEYDNLIAALEQLEEHGPITRRPFVDTLEGSRHPNMKELRPRPTKAGAHIRVLFAFDTRSRAIMLIAGDKAGNWSKWYAKHIPIADELFDAHQKRLHKAAAKATNRKPRKGKKR

SEQ ID NO: 5727 - protein, 134 aa, Mycobacterium paratuberculosis; identical to SEQ ID NO: 5726

SEQ ID NO: 5728 - protein, 399 aa, Mycobacterium paratuberculosis
VIRTQVCVAGGGPAGMVHALLLARAGIPVVVLEKHNDFLRDFRGDTVHPTTLRIMDELGLIDEFLRLPHTKIDTVAFDTDGSIRTFGNFKVLKRLGFNQPYIAMMPQWDFLDFIAEKASAYPEFTLIRNAEVTDLILEGDRVAGVRTPHDEVRADLVIAADGRKSAVRAAAGLRTAQAHSPMDVLWFRLKWRPGDPRELFGVFRKGLMMAMIYRGDYWQVAYLMPKGASPKGGSLEEFKERIVTAQPRLREHVNDLTSWDDTSELDVRVDRLETWWRTGLLCIGDAAHAMSPAGGVGINLAVADAVAAANILCAPLQQGLVTDRDLAKVQRRRELPTRIVQAVQVLMQDNAIAPNLNGDLSPIHVPKIVGFGPLQAIPPLVVGRGFRPEHVRTPDVHAR

SEQ ID NO: 5729 - protein, 254 aa, Mycobacterium paratuberculosis
MHKGATFAVAAVTAAIAPLAACANQQSSQPNTAPLTSSVPGSERLTTQLKTAEGIPVANASFEFANGYATVTVEAGPNQVLSPGFHGLQIHAVGKCEANSTAPTGGSTGDFESAGAVYQAPDHTGYPASGDLTALQVRSDGSAKLVTTSNAFTAADLRTSSGSALILHQNANNLANTPAADSGKRLACGVIAASSATSTTTTPTTSVTTSTTTVAVPPPSTSTSTSTVTVTGTPTATSTPTTTVTTPPSLPPGR

SEQ ID NO: 5730 - protein, 102 aa, Mycobacterium paratuberculosis
MPQPEQLPGPNADIWNWQLHGLCRGVDSSMFFHPDGERGRARMQREQRAKEMCRQCPVIQECRSHALEVGEPYGVWGGLSESERDLLLKGEIGRGRGIRRSA

SEQ ID NO: 5731 - protein, 276 aa, Mycobacterium paratuberculosis
VQADVAGSVDRLLAEAAFGDRPDRWPLPAAGTPAQLWLRAVAAGGQGRYGAALHDLARLRRTATAGRLASLAHSTQGSFLRQLGWHALARGWDGRALALAGDDPEAGADALIGLAADALGVGRFAAAAALLARVEPLLDSENIVPQRISVRRGWVAAELAMARGDGELAVRRAGEAVEAAAATAAGAAGAAARHRVKSEVVLAAALCSAGDIERARAVADTALHTTARLRLVPLRWALACLLIDIGSVEFSSRQLHEIREVCAGQVRRAGGTWRSA

SEQ ID NO: 5732 - protein, 198 aa, Mycobacterium paratuberculosis
LEISPSMTIPAGERLDAVVAKAVTGDHNALREVLETIRPIVVRYCRARVGTVERGGLSADDVAQEVCLATITALPRYRDRGRPFLAFLYGIAAHKVADAHRAAGRDLAYPTESIPDRWSNDAGPEQLAIEADSVSRMSELLEILPAKQREILILRVVVGLSAEETAAAVGSTTGAVRVAQHRALSRLKSEMIAAGDCA

SEQ ID NO: 5733 - protein, 266 aa, Mycobacterium paratuberculosis
VTVPESLDEFARTDLLLDALAQRRPVPRGQVEDPDDPDFQMLTTLLEDWRDNLRWPPASALVTPEEAVNALRAGLAERRRGHRGLAVVGSVAATLMLLSGFGAMVVEARPGSTLYGLHAMFFDQPRVNEKDQVMLAAKADLAKVAESIDKGQWDQARTQLTEVSSLVASIDDPATKQDLMTQLNLLNAKVDSRNPNATLPAAAPSMAPSVAVPAAPPPAASIAPTPAAPPAPLSPAPASTPSPSPSVGKHHHHGQPPAVAPVNPNQ

SEQ ID NO: 5734 - protein, 137 aa, Mycobacterium paratuberculosis
VRDHLPPGLPPDPFADDPCDPSAALDAVEPGQPLDQQERMAVEADLADLAVYEALLAHKGIRGLVVCCDECQQDHYHDWDMLRANLLQLLIDGTVRPHEPAYDPEPDAYVTWDYCRGYADASLNEATSDADGFHRRH

SEQ ID NO: 5735 - protein, 531 aa, Mycobacterium paratuberculosis
MTRGTSHLEDSSDLVGSAYVRVGGLVDDPVPTGGDNPHKIAMLGLTFDDVLLLPAASDVVPATADTSSQLTKKIRLKVPLVSSAMDTVTESRMAIAMARAGGMGVLHRNLPVAEQAGQVEMVKRSEAGMVTDPVTCRPDNTLAQVDALCARFRISGLPVVDDSGALVGIITNRDMRFEVDQTKKVAEVMTKAPLITAQEGVSADAALGLLRRNKIEKLPIVDGHGRLTGLITVKDFVKTEQHPLATKDSDGRLLVGAAVGVGGDAWVRAMMLVDAGVDVLVVDTAHAHNRLVLDMVGKLKAEVGERVEVIGGNVATRAAAAALVAAGADAVKVGVGPGSICTTRVVAGVGAPQITAILEAVAACGPAGVPVIADGGLQYSGDIAKALAAGASTAMLGSLLAGTAEAPGELIFVNGKQFKSYRGMGSLGAMAGRGSGAGKSYSKDRYFADDALSEDKLVPEGIEGRVPFRGPLSSVIHQLTGGLRAAMGYTGSPTIEALQQAQFVRITAAGLRESHPHDVAMTVEAPNYYAR

SEQ ID NO: 5736 - protein, 375 aa, Mycobacterium paratuberculosis
MVEIGMGRTARRSYELSEVSIVASRRTRSSQDVSTAWQLDAYRFEIPVLAHPTDALVSPEFAIELGRLGGLGVLNGEGLIGRHADVEAKIAQLVEAASKEPEPSAAIRLLQELHAAPLNPDLLGSAVARIREAGVTTAVRVSPQNAQALTPVLLQAGIDLLVIQGTIVSAERVASDGEPLNLKTFISELDVPVVAGGVQDHRTALHLMRTGAAGVIVGYGATRGVTTSDEVLGISVPMATAIADAAAARREYLDETGGRYVHVLADGDIHTSGELAKAIACGADAVVLGTPLAEAAEALGEGWFWPAAAAHPSLPRGALLQVAIGERPPLRQVLNGPSDDPFGSLNLVGGLRRSMAKAGYCDLKEFQKVGLTVGS

SEQ ID NO: 5737 - protein, 101 aa, Mycobacterium paratuberculosis
MKPDYDVLIIGSGFGGSVSALRLTEKGYRVGVLEAGRRFADEDFAETSWDLHKFLWAPKLGCYGIQRIHPLKNVLILAFMWLLCWMAEGDWPPGVPRRLDR

SEQ ID NO: 5738 - protein, 410 aa, Mycobacterium paratuberculosis; identical to SEQ ID NO: 4920

SEQ ID NO: 5739 - protein, 273 aa, Mycobacterium paratuberculosis
MSQSLTDKVALITGAARGQGRAHAARLAAEGADIIAVDLAGPLPPSVPYDSSTPEDLAETAELVRAAGRRVVTAQTDVRDLDALTSSVDTAVGELGRLDVIVANAGICSPAPWNRITAQAFRDTIDTNVVGTWNTVMAGAQHIIDGGRGGSIILIGSAAGINMQSFMVHYTASKHAVVGMARAFAAELGRYNIRVNSLNPGAVATPMGTGRMRDALRAAADDYPHLRGLHKPLLPEGIAQPEDIADAVAWLASDQSRLVTASQVSVDLGVGYV

SEQ ID NO: 5740 - protein, 70 aa, Mycobacterium paratuberculosis
MPTSEYQVSGMSCGHCEAAVHSEVARIPGVDGVSVSADTGRLVVTSAVPIDTDAVLGAVDEAGFQAVLVA

SEQ ID NO: 5741 - protein, 742 aa, Mycobacterium paratuberculosis
MSTPPRHVDEGTFPDHTASTARIELEITGMTCASCAARIEKKLNKLDGVTATVNYATEKAAVSAPASYDPQTLITEIENAGYAAAVAKPSPPRDDPELASLRRRLVTATALAGPVIAVAMIPALQFQHWHWAALALTAPVVGWCGRPFHAAAWANLKHGVATMDTLISIGTLAAFLWSLYALVLGAADRPGMRHDFELTVGHGAHVSHVAAPCHVYFEVAAGVTLFVLAGRYFERRSKRTAGAALRALLALGAKDVAVLRAGAETRIPIERLAVGDEFVVRPGERIATDGIVVAGSSAVDAAMLTGESVPVEVGVGDGVTGGTVNAGGRLVVRATGIGDDTQLARMAQLVERAQSGKADAQRLADRVSGVFVPVVLLLAVATLAGWLTAGGTLATALTAAVAVLIIACPCALGLATPTALLVGTGRAAQLGVLIKGPEVLETTRAVDTVVLDKTGTVTTGAMTVLDVVAADGTDRATLLRYAGALEAASEHPIAHAIARDAKAELGPLPTPTGFRAVGGGGVHGRVDGHAVAVGRPRWLAERGLRPDAALAAAAARAEHDGKTVVAVGWDGRARGILALADTVKPCSAAAVRQFTRLGLTPILLTGDNHTVARRIAGELGIGEVISGALPADKVEAVKRLQSAGRVVAMGTGTDVAIEAADVTVVRGDLRAAVDAIRLSRRTLATIKTNLVWAFGYNLAAIPLAALGMLNPMLAGAAMALSSVLVVGNSLRLRSFASIIPGA

SEQ ID NO: 5742 - protein, 500 aa, Mycobacterium paratuberculosis
LVGPPLSVIPADRSTATSPSRSARSSKRSRPLEQFFGQLSLLHGWLPPTVQGLALLMLVAAIHWRARGWLKRVLPAALVAAVAVTVLARWYITSLGVAGDPAPTALWFWIALSGLAAAVFLVGWRGVRWWRRGLAVLSIPLCVLCAGLALNGWVGYFPTVLAAWNQLTQAPLPDQIDRLRVTEMQIAGTRPSKGVVVPVDIDGNGPSGSHFAHRRELVYLPPAWFNSNPPPRLPAVMMISSAFNTPADWLGPGGAFTAIDNFAAAHHGFAPVLVFVDPTGSFDNDTECVNGSRGNAADHLTKDIQPFMVSNFGVSADRANWGVAGWSMGGTCAVDLAVMHPEMFRAFVDIAGDRGPNVGPKDQSVARLFGGDQAAWAAFDPVTVMTRHGRYADLSGWFEVPGADVARTAQQGNADPAPALVASSSDPAANPEGQDAAAHSLCAVGAANGIACAVVTQPGKHDWPFAAQAFATALPWLAWTIGTPNTEPVQLPQRAAAPPR

SEQ ID NO: 5743 - protein, 283 aa, Mycobacterium paratuberculosis
VALPPDDRRPACPAMNRRQFLGSLAASVVAGVGAARLIVDPQPRTFAQTPAAAIPTSGPTAPQALLPPPPLSARIPLPGGGALMKIPGEGDLLALTVDDGVNSEVVRAYTQFAKDTGVRLTYFVNGVYDSWTENLQLLRPLVDSGQIQLGNHTWSHPDLTTLTKEQVAEQLSRNDAFLKKTYGIGAKPYWRPPYAKRNAAVDAVAADLGYQVPTLWSGSLSDSTLITEDYILQMADQYFTPQAIVIGHLNHLPVTHVYPQLVDIIRERNLRTVTLNDVFLKTP

SEQ ID NO: 5744 - protein, 151 aa, Mycobacterium paratuberculosis
MREGARGGWEPTVPALVNLVAAAGAPRLRAAFAEAGLDGIRPAQSLALVPLAAGGLHASDLADRLRVSRQAVAQAVAALERHGYVTRTPDPADARARIIELTPRGRQALQVMRANAIAMEKRWRKVLGERRLTELRETLTVLLAAEREPGG

SEQ ID NO: 5745 - protein, 323 aa, Mycobacterium paratuberculosis
MPAGCHHGPMRFGCARAVNLGLLPVLVVVLAGCLAGGHALGTPDSQSIPVGPSTHTLQSGGTPRSYHLYRPQGLSEAAPLVVMLHGGFGNGEQAERAYHWDAEADAGHFLVAYPDGLGRAWNAGTCCGEPAHAGTDDVGFVNAVVGAIAAQIPVDRARVYVTGMSNGAMMALRLGCQSDTLAAIAPVAGTLLTDCSAARPASVLQIHGTADDRVPYAGGPGKAFALNGSPRVDGPSVESVNATWRAIDACGPPSSTTAGDVTTQTAGCADGRTVELISVAGCGHQWPGGAPSPLAEKVAGIPAPSTALDATDTIWQFFARNHR

SEQ ID NO: 5746 - protein, 436 aa, Mycobacterium paratuberculosis
VRDCYRSVMRRVAGVFAALVLMAGTLTGPAIARADGDEPQYADFYTPPDPLPPGRPGDLIRTEPSRLVLEPSGQLGAIMATGTRIMYRSTDTRGNPIAVTGTYFEPYNDWPYGGPRPLMSYAPGTQGQGNQCAPSRMFNQGIHYSGGWDIMFNYEELFVATMVARGFAIVMTDYQGLGTPSMHTYVGRVAEGQAVLDAARTAMRLPGTSLDPHGPVAFWGYSQGGGATASAAELAAQYAPDLHIVGTYAGAPPADLKELLPYADGSALVGVVGYALNSVMAAYPEFADAIRSKMTPRGLAMLESVSRQCVGQTLLDFMFRHIQPYFTEDINQLVNEEPFNSLFEAQRIGRYKPNAPVLINSNRYDPLVPWTAANQLGRDWCAQGADVEFRTNEEPPFLNKLVINHALPMLVDGEPAMQWIAARFRGEPTAPNCGQF

SEQ ID NO: 5747 - protein, 186 aa, Mycobacterium paratuberculosis
LLGGNGLHGVSHPKVDDRAGVPAGTTSFYFRTRKALVHAMAGRLAELDVADFSMMAELAEDHATEFAGTAGLARIVMYVNSEPWLTRAKARYELALLAGRDPELAAALSESADRLYALARNVVTQWHPAGSAPDPALVDDQATATLAFINGIMLTFVAGQPAVDDAGQLDRLIQGVIAGVAHVRGA

SEQ ID NO: 5748 - protein, 202 aa, Mycobacterium paratuberculosis
MESKRRTQEERSAATRDALIAAARKLWGLRGYTEVGTPEIAAAAGVTRGAMYHQFADKAALFRAVVEAVEQDVMARMAVVVAESGASTPTDAIRAAVDAWLEVSADPEVRQLILLDAPSVLGWAEFRDVAQRYSLGMTEQLLTEAIRAGELAEQPVRPLAHVLIGALDEAAMVIATADDPDRARRETRQVLQRLVDGMFDAR

SEQ ID NO: 5749 - protein, 276 aa, Mycobacterium paratuberculosis
MSTIDISAGTIHYEATGPADGRPVVFVHGYLMGGQLWRQVGDRLAGRGLRCIAPTWPMGAHPEPLRRGADRTITGVAAMVAELLSALDLEDVVLVGNDTGGVVSQLVAVHHRERLGALVLTSCDAFEHFPPPVLRPVILAAKSKATFRAVAQAMRAPAVRKRAFDGLAHSNIDALTELWVRPALSLPAVAEDLRRFTLSLRTEVTTAAATRLYDFDKPTLIAWSADDVFFAQEDGARLAATIPNARHEVIAGARTFSMVDQPDRLADLLSTVAVRT

SEQ ID NO: 5750 - protein, 253 aa, Mycobacterium paratuberculosis
VTDELRGRRILVTGAATGIGAAAVSVLTDAGADVVATYHTTPPPPDLTAHWLQCDARDADAVSALVHRAAEHLGGLDVLVHAAGLWQPGIPGCIGADDISFLLDTNVKATILTNQAAHAAMKAQDPKGGRIINFGSSEAVMGSPISAVYAATKGAVQAWTRSAAKAWAADHVTVNALAPAVQTPGADRLRAFLGPDAAALIDQQMQMMIPLGGALGEPARDLGPMLVFLAGSGSGFITGQLLAVDGGLMMVGA

SEQ ID NO: 5751 - protein, 546 aa, Mycobacterium paratuberculosis
MAEDTIQALLRKRWSDPGVAVKYGDTQWSWAQYLRDAAARAAALLGAADPGRPMHVGTLLGNTPEMLSQMAAAGLGGYVLCGLNTTRRGEALAADVRRADCQFVVTDAEHRPLLDGLDLVGTQILDTSTPDWAGFVDAAGELTPHRDVAAMDPFMMIFTSGTSGNPKAVQVSHLMAVFAGSNLVQRFGLTEHDTCYVSMPLFHSNAVVAGWAPAVCSGAAIVPAKFSARNFLDDIRRYGATYMNYVGKPLAYVLATPERADDADNPLRVAFGNEANDKDIEEFGRWFGVQVEDGFGSTENAVIVIREPGTPRGSIGRGIDGVAIYNSDTVTECPVARFDADGALINADEAVGELVNTAGSGFFTGYYNDPDANAERMRHDMYWSGDLAYRDADGWIYLAGRTADWMRVDGENLAAAPIERILLRHSAINRVAVYAVPDGHVGDQVMAAVVLNDGETLTPAAFEAFLDAQPDLSPKARPRYVRIAADLPSTATHKVLKRQLISQGTAVAAGEVLWEREPRGTAYTVVASPDCGVPGDGSAPSTVAPV

SEQ ID NO: 5752 - protein, 182 aa, Mycobacterium paratuberculosis
VSPRTSNGLPVTAYLVLGVLAANDERLTAGEIKMRAELSVGHFYWSPSVSHVRRELTRLLARGMVAQTGSQSGKRAITLYETTDAGRDALRRWVQHFPGQDQVVIKHPVILKTWLARGEDPERIVDTLERHLDATRARLDEALWSRRRSQELGITADPEQRFSFAVLDYAIRGLYAEISNIS

SEQ ID NO: 5753 - protein, 143 aa, Mycobacterium paratuberculosis
VTAEPLRPQTGPVPHASSPLSVPFWEGCRSRQLRYQRCRACDLANFPPTEHCRQCLSDDIGWQQSGGRGEIYSWTVVHRPVTAEFIPPNAPAIITLDEGYQMLTNVVGVPPGDLRVGLRVRVQFHTVAADVTLPYFTDETDGS

SEQ ID NO: 5754 - protein, 388 aa, Mycobacterium paratuberculosis
MKTRPAKRTAAIVGVHNTRQGRRLDGETSRSLALKAIRGALDDAGLCLDDVDGISAGPLSTALIYDLRLGPAWQGLGFGVGMITEAATAIEHGMAEVVVLVASQAGEYRDHEATAPWTRPENEFVAPWGMFTTAEFALIARRHMHVYGTTREQLSTVAATIRNNGSRNPEAVYYRRGPFTPDDITASRPIADPFHLLDCATTSEGGCALVLANLEKVDTASQPIYVLGSGADFHGPSYQHPPAFDLAGRRGGDVNGVVGRRAADCAFAHAGLRRDDVDVLELYDPFSFEIIRQLEAFGFCEDGEGGPFVADGHIALDGSHPVTTDGGTMSFSHAGSNPQMMQRAIRAVQQLRGQAGELQVPDAHIALCSNGGAGALFTTVLILGDEPR

SEQ ID NO: 5755 - protein, 776 aa, Mycobacterium paratuberculosis
VGPAPFAHWRVLEFSNGLAVSYCGKMFADAGADVVKVESPQGDSMRRWSAGGPPGALFGYLAAGKRSVVGRGRAEVAALLAGADLVLTDLTDGWTLDELTGRTGPSAVVVAITPFGTTGPYVDQQVVANEFILQALCGSIAGRGWPGDEPVQAGGRLGEWLAGTFAAAAAAATARHAARTGRGEVIDVSTYEAMVIAMGGLSAMSASVLGADSLLHERSLELPSIVPTADGMVGFCTITAQQFQDFLVMIDRADLVDDAELASFAGRVARRDEFLDMVTGWTRTRTTQEIVDLAVAFRIPVAPIANPETLAKLDHFVQRVVFVESPAGVLAPRVPYRSDAITTRPPSEPPALGADNGRVHWPPRPEPARGEDAGTLPLSGIRVTDLTAFWAGPVATQLLGALGADVIKIEGVRRPDGMRFSAGRPPDWDQWWEWGPVFLCSNNNKRGISVDLGTEAGRSIALGLIAAGDLVVENFSPRVMANFGLEWDAVRAANPRAVMIRMPAFGLDGPWRDRVGFAQTMEQATGMAWMTGHPEGPPVIPRGVCDPIAGLHAAFAAVAALTVRDREGTGMQVEATMVEAALNVAAEMLVEYSRNGIALRRNRNRGPGASPQGVYRCRGDDAWVALAALDDTARASLARLLGRAEPGDTGWDEHADDVDKLISDWAAGRTVADAVDALRAAGVAAAPVTPAAALLADPQLHARGFWETVDHPVAGTFLCTGMPFAFLGKPRRWLRRVPPRYGEHTAEVLTELLGHSDADLAELRASGTISDRPAGL

SEQ ID NO: 5756 - protein, 451 aa, Mycobacterium paratuberculosis
MNKDDLILISVDDHIAEPADMFDAHVPAKYKDRAPRVVVEPDGIQQWYYGDIHGRNMGLNAVAGKPREMYNIDASRYDEMRPGCFNVDERVRDMNAGGQLAGLNFPNFTGFSGQVLNQAPDREVNLVMIKAYNDWHIDEWCAAYPGRFIPCGILPLFDVAEAAKEVNRLAAKGCHAVTFSENPEALQMPSIHTRYWYPLFEAVCENKTVLCTHVGSASRSPQVSTDAPPSVQMTASSMMSMFTFTELIWAQFWADFPELKFSLTEGDVGWIPYFLWRAEHVYNRHSGWTLATFPPGYSGPTDVFKRHFYTCFISDKVGVRNMDWFNEDMLCWESDFPHSDSNWPFAPEDVIDTMGHLDDAVINKITHENAMAAYSFDPFRHIPKEQARAGHLRAQATDVDVVTHVGHRASQRDRDAWARMTQFALQAQASAQAPVTVEAAGIAGRATTLGN

SEQ ID NO: 5757 - protein, 334 aa, Mycobacterium paratuberculosis
MTGPQGNGNSSSNKAARPTTADVARLAGVSTATVSYVLNNARGRRISPDTRDAVYRAAKLLGYRPNLAARNLARGKSGVVLYVVPHVAVGEMPMQAGSRMTTALAREGLLQVQVFETDDDQHVVDAIANLDPVAVTSLFPLSAAARRAVTEAGIPHIEIGTLPALNDPHLSVGEMRIAHLVERGHRRIAFAYTGIARWRPLGDYWFEGVSRAARLRGLPPVRADEVTLDTAASVVSAWVRDGVTAVCAQSDEIACLVLYGIHRAGLRCPGDLAVMGVDASPMGMVSTPPLTTVQFDPCAVADAALAAVFERLGHAAPPSPELTDIARLVVRSST

SEQ ID NO: 5758 - protein, 137 aa, Mycobacterium paratuberculosis
MTTFERPMPVKTPTTAPFWDALAQHRIVIQYSPSLQSYVFYPRVRAPRTLADDLEWREISGMGSLYSYTVAHRPVSPHFADAVPQLLAIVEWDEGPRFSTEMVNVDPAQLRVGMRVQPVFCDYPEHDVTLLRYQPAD

SEQ ID NO: 5759 - protein, 402 aa, Mycobacterium paratuberculosis
MGLRGEAAIVGYVELPPERLSKASPAPFVLEQWAEPGAAALQDAGLPGEVVNGIVASHLAESEIFVPSTIAEYLGVGARFAEHVVLGGASAAAMVWRAAAAIELGICDAVLCALPARYITPSSKKKPRPMVDAMFFGSSSNQYGSPQAEFEIPYGNLGQNGPYGQVAQRYAAVYGYDERAMAKIVVDQRVNANHTDGAIWRDTPLTVEDVLASPVIADPLHMLEIVMPCVGGAAVVVANADLAKRARHRPVWVKGFGEHVPFKTPTYAEDLLRTPIAAAADTAFAMTGLSRAQMDMVSIYDCYTITVLLSLEDAGFCEKGRGMEFVADHDLTFRGDFPLNTAGGQLGFGQAGLAGGMHHVCDATRQIMGRAGAAQVPDCNRAFVSGNGGILSEQTTLILEGD

SEQ ID NO: 5760 - protein, 86 aa, Mycobacterium paratuberculosis
VRETIRLLDGQASGPASSIAKVAMNVLLRRTFEATLQLTGRLAMAADSDPAVVEPYLHLPAELIGGGTREIQLNIIAQMILGLPRK

SEQ ID NO: 5761 - protein, 678 aa, Mycobacterium paratuberculosis
MTLGLSPEQQELGDAVGQFAARNAPIAATRDSFAELAAGRLPRWWDGLVANGFHAVHLPEELGGQGGRLMDAACVLESAGKSLLPGPLLPTVAAGAVALLADPAPAARSVLRDLAAGIPAAVVLPGDGDLHAGAGDGHWLLSGASEVTAGVCAARIVLVGARTRDGELVWAAVDTEKPTATVEPISGTDLVADAGVLRLDNHRVLDSEVLTGIDPERARCVVLGLVAATTAGVIQWCVQAVTAHLRIREQFGKVIGTFQALQHSAAMLLVSSELATAAAWDAVRAGDESLEQHRMAAAGAAVMAISPAPDLVLDALTMFGAIGFTWEHDLHLYWRRAISLAASIGPANRWARRLGELTCTRQRDMAVNLGDAESELRAKVAETLDAALELRNDQPGRQGDYSEFETGPQRTLISDAGLIAPHWPKPWGLDAGPLRQLIIDDEFAKRPALVRPSLGIAEWILPSVIRAAPKDLQEKLIPPTLRGEIAWCQLFSEPGAGSDLAALSTRATKVDGGWTINGHKIWTSAAHRADYGALLARTDPQAGKHRGIGYFVVDMRSAGIEVQPIKTATGDAHFNEVFLTDVFVPDDMLLGEPTGGWNLAIATMAEERSAISGYVKFDRAAALRRLAAQPGPDRDDALRELGRLDAYTTRSRRWECARPSGCSTARRPGRRPASPRWR

SEQ ID NO: 5762 - protein, 226 aa, Mycobacterium paratuberculosis
VADYRGGSGYVKRARSPASGRRLRIRRSEDHQMPTDPNGPAAPRRRSEKSRTAIVTATRELLLERGFDGLTIEAVAARAGVGKQTIYRWWPTRPALVADVMLEDADRLLASVEHSGDLAADLVGWVGKLVTSLTTPRGSAMLRTLTVACMEHEDTAVKLRAGFSAPLHDSVRARLLAEGVDAATAESAADAIVGGVVYPILSGAQRYSRRRAEHTTRLIVAALTAG

SEQ ID NO: 5763 - protein, 306 aa, Mycobacterium paratuberculosis
MTVEADPERPSFFDMCSDNRMVGGPNPDGNYYLAMIRGDRRYRITGTRGTSAYLGFQILAGTGLTPRRMAGYLSDADLASEAGQFALLLSADEPSDPAGAQWVKIPPDASSVVVREYIGDRAAEQLAALRIEALDPGPLTPLTDEQLADQFTAMAWSLMKLATLHLTIKPELLQSPNTLLTAQAADLGEADTTPDNLYMMGTFRLDPGQALVLDIAPPDTRYWNVTLESIWHECLEPRRRHSSVTNRGVRPDADGRVRIAISARDFGFGHWLDTGGRHRGFVVLRWLDNPSPPEVAVSVREARERP

SEQ ID NO: 5764 - protein, 390 aa, Mycobacterium paratuberculosis
VSLQDRFAPERLIAAACEEAGSDDFGAEGWRPGLHRLTDGLINDARLSDIGVEIAHLDIMRALKNRLNVIAWRKAHPEVAEQKISAPIFIVGQPRTGTTILYDLLAQDPALRAPLTWEVDEPCPVPRPETYHDDPRIARTQAGIDLSEQIMPGFLAFHPMGALVGQECVRITAAEFVSMIFSVQYRLPNYYRWLLYEADHAGAYRFHRIFLQHLQSGVPGQWLLKSPAHLWQLDALLAEYPDALIVQTHRDPLNVISSIAALTHHLRGMCSDESSITECAAQSYEEIVVGLDREMALRDRGAVPPGRVIDVQYADFMKDPWTTIKDIYERLDRELRPDAEQRMREFLASHPSDGGRSRYTWSDTGLDAGAVRERVRTYQDRYGVPTEALR

SEQ ID NO: 5765 - protein, 355 aa, Mycobacterium paratuberculosis
VDDDCLKLTTYLAERRRAGNRFVSDVLLDLYARHRVECAVLLRGIGGFGTGHRLRSDESLTLSEDPPVAIVATDTRTKIEALLDEVLAVKQRGLVTLERARLLHADVGAARPPEGDAVKLTVYLGRKQRVNGTPAYIGVCDLLHRRGLAGATVLLGVDGVVHGERRRASFFGRNVDVPMMIVVVGSGAHIGRVLPEIAALLRRPLFTLERVRVCKRDGQLLEPPHALPGVDERGLPLFQQLTVYTSESARHGGVPIHRAIVARLRQATAADGATVLRGVWGFHGDHPPHGDGLFALTRRVPVVTIVIDTPAHIAESFAVIDELTGAEGLVTSEMVPALVSDDGGPGAGRMARHRY

SEQ ID NO: 5766 - protein, 309 aa, Mycobacterium paratuberculosis
VPVRAMRKWESSMSNQQQAERMTSGKGFIAALDQSGGSTPKALRLYGIEDSAYSSEKEMFDLIHQMRSRIITSPAFTGDRVLAAILFEQTMDRDIEGKPSTTYLWETKGVVPILKIDKGLAEASDDVQLMKPIPGLDELLQRAVSKGVFGTKERSVIGGANPVGIAAVVAQQFELAHQVLSHGLVPIIEPEVTISIADKAKAEGILRDEITKQLDSVPDGQRVMLKLSLPTEANFYRPLIEHPKVMRVVALSGGYSREEANELLAKNAGLIASFSRALTEGLTVDQSDEQFNATLDKAIQSIYDASVAG

SEQ ID NO: 5767 - protein, 110 aa, Mycobacterium paratuberculosis
VGKHQVDQAVVLTVSGEVDMLSSPMLAEAIQTALAAKPAALIVDLSKVGFLASAGMTVLVTTQAELQPPTKFAVVADGSATSRPIKLMGIDSVLSLYPSLNDALSALSGA

SEQ ID NO: 5768 - protein, 361 aa, Mycobacterium paratuberculosis
VTLGTERERRLTGWLRGRLPDADDVRVEGIDRVSFGHSAEMMTMSVIAARRGRDERRDVVLRLRPSPPALLEPYDLARQFGILRALADTDVRAPRALWLEPTGDVLGRPFFVMERVAGEVYEMQPPADASDDTVARMCESLAEQLAAIHAVDLTRTGLATLDDGAGHLDRELGHWAAEMNRVKRGPLPALERLHRALLAGKPAPCPRITLVHGDAKPGNFAFTGGEVSAVFDWEMTTVGDPLTDIGWLEMLWMQPVGINSHPAALPIDALLAHYQSASGIEPVNRPWYRAFNAYKMAVICLIGAMLVEDGHSDDQKLVLAAYGTGLLTKAGLAELGIDEPLDDGPVLPRQERIQQVLARAQ

SEQ ID NO: 5769 - protein, 391 aa, Mycobacterium paratuberculosis
LPRNHIASQKGRLMGYSAADESFTHQLPTTFDQVHDADPTWSDRCYFFAAAPDGTMLLASGYGNNPNTASGLGYVKVSLADGRHWDLLSGRPVTGDDRGELRAGPMRWTCVEPLKKWRLDVGPNNSGIEWELYYEPTAPMWELLPMKVSGPDGRLLADMYHMKEPGRWSGWVRIDGQRVSVDGFNGGRDRTFGVRVSDRIDFWLWLDAGFGDHAVEAWVIESCDGTVLYVDGGITYADGTLSKRFVKIQHEVEFDGERKRPVRAVLVFTDEDGRAHRVVAEAPHPQVNAYYGLPMAHCHYEDLGGGAYFIHFAWDSSDPEQLSETEDKSMALDQLMRFERDGHTGWGIFELLLGGQGYRRYPNWRAMDMSAFTQDKTPVDRLPADGDGADR

SEQ ID NO: 5770 - protein, 206 aa, Mycobacterium paratuberculosis
MEPSRRWGDDRAILDDEEARRRILEAAGRCIVRRGNTQFRMGEVADEAGVSRSTVYRYFPGRDDVLLGLMLRRVDHALAESVRSLPAPEDPVRSVPRMVLARVESVDGNPLNEALFAAESTAMASALQKGSEPLVELLLRHYGPLLERWKAAGLLYPDVDFRSVVQWLHTATLFLLAPSWRYRPHADKRRFVEQFVVRALVPQIRQ

SEQ ID NO: 5771 - protein, 374 aa, Mycobacterium paratuberculosis
VGHAFSFLGLAAHLGRGAGRVSVDAVLGGRFGLPRTVDEIDPAVLSRVMGTTVRTVRVLSRDAGTSSRARLVLTGKDVPDSVFVKVAAQTAATRLMGELGRLGCTEVRFYRQLAPQVVGVPYCYGAAFDAWTGRYLLVLEDLPAEACEFPDTLHPLSADQAGLVVELLADLHATFWNRLPRDGRGPLGWLYTPSGDVTSLLTGSLMHSSIKRLAERTSIPVRDGVFIADNYRAVAALIDAAPHTVMHGDAHPGNMYFHGGKAGLLDWQAVRRGHPSRELAYTLITSLTPEDRRATQRDLLDDYRRALAAAGGPQLDRDELWLRFRQAALYAYAAPLITAGMGGMQVEDIAMEGLRRGVAALEDLETVAALKSSL

SEQ ID NO: 5772 - protein, 588 aa, Mycobacterium paratuberculosis
MFDLKITGGTVVDGTGAQRYRADVGIRDGKIVDVVRADGSEAGGLATAEAAETIDATGKIVAPGFVDIHTHYDGQVSWDSLLEPSSGHGVTTVVTGNCGVGFAPVRPGTEQWLIELMEGVEDIPGTALTEGITWGWETYPEYLDAIGKQKFAIDVGSQVAHGAIRAYAMGERGARNEPATPDDIEAMGRLVREAIEAGALGFSTSRTMGHRAMDGEPVPGTFAAEEELFGLGRAMAAGGQAVFELAPQGAAGEDIIGPKKELDWMRRLSGEINRPVSFALIQVDADPNLWREMLDLSADAHAAGARLYPQIAARPFGMMIGFQGHHGFSHRPTYRRLAAECSREELAQRLADPAVKAAILAEDDLPVDPTLLFDGMFALVQHSLHRLYALGDPPDYEPTPDRTVAAIAEARGEDPLATLYDLMLEADATNMLMLPLFNYADGNCDAIREMLLHPAGVLGLSDGGAHCGMICDASYPTFLLTHWARDRSRGDKLALEYVIRKQSRDTAHLFGLTDRGTIEPGKKADINVIDMDALRLHPAAMAFDLPAGGNRILQGASGYAATIVSGTVTRRNDVDTGARPGRLVRGAR

SEQ ID NO: 5773 - protein, 448 aa, Mycobacterium paratuberculosis
MAAAAGNPARTRDEDAIGTPPPGPTLVPAERYYSPAFAALEVERMWPRVWQLACMVDHVAAPGDYFEYRCGPYGVLIVRGDDGALRAFQNVCRHRGNSLCSGSGSGLRELKCGYHGWTWDLAGALKRVPDRKGFGTLRLSDYPLIPARVDTWAGLVFVNLDPDAMPLPEYLEAIPEDTAWCRLDEFRCYATLTVEVDANWKTVADGYSETYHIQTLHPELLRCVDDIHAPQQIWGHTGKSDQPYGVPSPRFEGALSDEEVWDAYVSTQGALMGAAEGTPFPAADHRPGQTVADLIADRTRAFAASRGVDLGWADTDRITRLHQYNVFPNMTFLTNADHLTVMCSRPAPDPAAAPDKGELVMFLTTRMPPGAPRTKPTDVRMSAGEAEPGLVLTQDIAVLAGLQRGMHQPGFTHLVLSSEERRVINMHRNLERYLDLPAAQRMSGGAGT

SEQ ID NO: 5774 - protein, 126 aa, Mycobacterium paratuberculosis
VMTPSYPWGDDRGQLAQQLRLRYHTLRRRRARRLCHSFERVGVRTAPERLREMLAGAPLAAHEVINVNFALIAIQLNREARVARYRRLRQRGARSLMFAGLIMVVINFLMCMAYLLLNLAEPAAPL

SEQ ID NO: 5775 - protein, 218 aa, Mycobacterium paratuberculosis
VTDPAPEIAVLLVDDQDLVRSGLRRILRRKDGFVIVAECADGDEVPAAIAAHRPDVVVMDLRMRRVDGIEATRRLGGRPPVLALTTFNEDELLSGALRAGAAGFVLKDSSAEELIRAVRAVARGEGYLDPAVTSRVLTTYRKAAPGPRGAAIAELTTRERDVLTLIGKGLSNSEIADELCISGVTVKSHIGRIFGKLDLRDRAAAIVYAYDNGIVAPR

SEQ ID NO: 5776 - protein, 406 aa, Mycobacterium paratuberculosis
MLRAAICHLREQLRRRGELIPVGLTWASLIAVDAALLLGGTIGTLQRPAADLPVSLTAFAIALSPTVAFFVFNMKMTPGPLWATWTASTALTLFGTSTPIRADFAPALLVLMVLVVATLASVVGGLLAAASAAALLLTAAALHRLDAIVLYLGFIVAAWLLGYLMRTQRLLVAEQIEAQQMLAEHAAADERRRIAREVHDVIAHSLSITLLHVTGARRALRQDRDVDDAVEALEQAERLGRQAMADIRRTVGLLDNWPTKAAPTTPEPGLDDVASLVDGFRRAGLAVTLCVEGPTDHVSPAVGLALYRITQESLANIAKHAPESKAGVVLDISPASARLAVTNILPAAVVAARSPEGRGVRGMRQRVELLGGAIDVGPTRDGWSVCAEIPLQESDGSWRPWWCGKA

SEQ ID NO: 5777 - protein, 126 aa, Mycobacterium paratuberculosis
MTWALLHDRMAFMAEVIKTAETDPSAALALIDNSPRVPELFGDAEGLMLSLGQRWITTLVAKLDQAAHEGTSAEQVRADLEAASPGLHALVTIGARRSLRMRSMARGEHVAVSLFGGPSGDRQTVA

SEQ ID NO: 5778 - protein, 952 aa, Mycobacterium paratuberculosis
LPDRPGILGRLTGRYALLVVGLWVLAAAVANVAVPQLERVVDSHARSFMPPSAPSAVAAARAAQLFDQTPSNNFVYVVLERNQRLGAGDRQFYDALTAALGSDHRHVYAVTDLWSQPATAAGAQSTDGQAVSVMVRLAGMLGTAQARDSVNAVRATAQKLGPPAGLQVHVTGPGATIVDKFSAIDRQMLGITAATIGLILLLLLVVYRSPVAAAIPLISVGLAFALARAVVAALGQANVIEVSLFSVALMAAMTLGAGTDYAIFLVGRYHEARRGGVAPAQALTVAYRSIAPVVIGSALTVSVALACLVFAHVGSFRSAGLPCAIGILATMVAALTLTPALMSLAVRRGYLEPRPSRTARRWRRVGTTVARWPGPILVAALGLTLLVALPLAGMRIGFNEPAATPSSTDSNRGYASAGRHFPENALLPDVIAIRADHDLRNPAGLIAIERITRHIMAVPGVRAVQSASRPDGKVPEQATLSYQAGVLGRQFGDTVDSLTQRLARVSELDGALAQTQHAVDGLGNGLRGGSAGLADMSGAADDMRAGMDGLQRNVTTVSGYLDPLRDFVGRTPDCAANPICSTVDRVLAPVDSLVQTSAQLGSGAAKLTTGSNTAATAMAGLPQNVDAMKSALVQARSATRDLLGLSDTLGPQMHQLTDYLNEISTQFQGSAAADFYLPQRALTDPRYTAVLNHLISQNGRAAYLLVYGDGAEWGADGAGRAEQVRAAIKEATKEGTLTPVEVDLAGVGPVTADLQRFVADDTRLLVGAALVLIFLIVTAMLRSPVAGLVVVGTVVTSYASAIGASVLIWQHLLHQELHWAVAPIAFIALIAIGADYNLLLALRIKQEAAAGLRTGIIRAFGGTGGVVTVAGIIFGLTMLALLTSSVLSIAQIGTTIAVDLLLDTLVVRAFIVPSIVALLGRWFWWPSPLPRRGVARVVKTVEPQPLSVATAV

SEQ ID NO: 5779 - protein, 1403 aa, Mycobacterium paratuberculosis
MSKKAFPINRVKIEPPKPVRVAPAAPIALPEREPRNIWVMIGVPALIVALIGTIVMLYVSGVRSLSTGFFPLMGIGAFSMLAFSGRFGRARKITWGEMEKGRRRYLRDLDSNRDEIQSAVCAQREWQNSVHSDPRGLGAIIGGPRMWERGRGDEDFLEVRLGTGVQHAPDSVLSVTWPDVASDEELEPVTGQALRDFILEQRKIRDIAKVVNLRSAPGFSFVGEDLDRLRSLMRSVLCSLAVFHNPRDVKLLVVTRNPEVWSWIVWLPHNLHDELFDACGWRRLVFATPEELEATLGAELHMKGKRGPWTPLAAASPTAMGSALETATDTVDLGPHLVIVDDNTGSPDAWESVVGQVGKAGITLLRIASRVGTGVGFAKDQVFELSERHSTPNGSTNGEIALRRNGSDADGEDGRPAPLLRVRNKFFAHADQLSIHRAYRYARAMARWSPTSRSEIDDSVSGATELLRALGISDPRELDVDRLWAERRGRGDERWCEVPVGAKPNGELQNIIIRAKDFGGFGFHSVVIGTSGSGKSEFFLSLVYGIALTHSPETFNVIFVDMKFESAAQDILGIPHVVAALSNLGKDERHLAERMRRVIDGEIKQRYELFTSVGARDANDYEEIRLAGRDLPPVPVLLVIVDEYLELFANHEKWINLIIHIGQEGRGANVFFMLGGQRLDLSSLQKVKSNIAFRIALRAESGDDSREVIGSDAAYHLPSKENGFGLLKVGPRDLEPFRCFYLSAPFVVPKTKEVAATVDMTLTKPRLYNWQYQPLDAADATALEQAAAVDAEPDEFLYYEDGFKRKKIVDVLRESLQNVPHRSPGRPWLEPLEDPEPIDVLVAGYRGKPWHVDYGQNPGLMFPVGVMDIPEESKQVVHAVDALRSNVIVVGAKQRGKTTTLMTLMCSAATMYSPARVTFFCIGGATLAQAASLPHVTDIVSPKDAEGIERILSSMDALIDARENSFRQLKIDLDGFRERRFGPGSDGLGGTDANDPFGDVFVVVDDYDDLYSKDTVLGDRIISLSSRGPEYGVHVMCSAGGWIHGQRQSLLQNATARIQLRLADPSESQMGHSSLESRDAARRTLNRPGFGLTDSLHELRVGVPALTDPATGQMVSIVDVGARIADVAGVTKHATLQRLPQRVELKTILEYQAAHPSGDDLSIAFAIGERHELGPVPINLRESPGLMILGRQGCGKTLSLVAIGEAIMSRFSPEEAQLTLIDPKTAPHGLRDLHGPGYVRAYAYDQDEIDEVITALAQQILLPRLPPKGLSQEELRALKPWEGPRHFVLIDDIGDLRPDQSYPPKPPVGAALWKLMERARQIGLHVFTTRNSANWATLQMDPWIRFQNSAKVAQLYMDNDPQNRINRNVRAQALPPGRGLLLSADGDVEGVLVGLPSTVITPQ

SEQ ID NO: 5780 - protein, 118 aa, Mycobacterium paratuberculosis
VHLVRDDRDPASLVANQVLVLPGAANFVTSTSGVVTSDSRESLFWVSDYGVRFGIANDESTLRALGLDPGSAVQAPWPLLRTFAAGPALSREAALLARDTVPALGKVAVVTTSAKPGG

SEQ ID NO: 5781 - protein, 371 aa, Mycobacterium paratuberculosis
MPLSLSNRDQNSGHLFYNRRLRAATTRFSVRMKHDDRKQTAALVLSMVLVAIASGWMMLLNVLKPTGIVGDSTIIGDRDSGALYAKIDGRLYPALNLTSARLATGTANQPTWVKPAEIAKYPTGPLVGIPGAPAAMPVHRGAISAWAVCDTAGRPRSPEKPVVTSIAGPLEGFDRATPLRDDAGLLVTFEGNTYVIWGGKRSQIDPVNRAVTLSLGLDPGVTLPVEISRALFDALPATEPLGVPPVPLAGTPSTWVSGSQVGAVLQAQTASGGTQFYVLLPDGVQKVTSFVADLLRSANSYGSTAPRVVTPDVLVNIPEVTSLAVDYYPTKRLNFIDTAANPTTCVGWEKGSTDPQARVVVYNGRGLPTPS

SEQ ID NO: 5782 - protein, 288 aa, Mycobacterium paratuberculosis
VGKPVTDPLRMQAVAALSRGHELFAGAPTRDRLGAPTARPRTTSPSTLPAAVVARSGALAQRLAQSDDADRVLRTVLAAARADHAHGRAATGTVLDAALADAAPAADTPLGRREAMARMAARLRTQHRHISRSRRRARLLALRLRRLHYRRRRPAAGPTNQPGGRPAVLAAIRKALDIKGIHDPAARARWERGMDLVARRESNYNAGAVNDWDANAARGTPSKGAWQFIEPTFAAYHQRGTSRDIHNLVAQACAFINYAMGRYGVAADASNLADRIQQADPRRSPKGY

SEQ ID NO: 5783 - protein, 306 aa, Mycobacterium paratuberculosis
VGGPGGIIKNDLPTTTAIVGGPPASIPRPFPVPPGGTSPADAGQGMVGGAGNANVPKDAADAAAADADRKARAADAAAKFPANEANGSQEMQMLQQMLSSVTGALGGAMGGVMGPLTQLPQQAMQAGQSALQPLMSAVQGAHGAASLADNAHLVDSVGGAGSGLGGGAGAGGGGAGLGGGGTVPTSSLGPPPVPTSSPPTTPAGAKAAMMPPTGGMPAMPGQTGMTGMPMMPPGAMGAGGEGGNKDKPVEKRVTAPGVPNGQPVKGRLTIPPSAPGSKPGEAKPTVVTNRPNRRIVIMPSDDEPKE

SEQ ID NO: 5784 - protein, 719 aa, Mycobacterium paratuberculosis
VGLDLPPGTWTAALIGPWWPAPSTALRAGAQHWSESCVEQQIYSQTLRTQWTLFAAHNQGHTADDLIDRFQQGEKFHLDLAEKYQAKASAFNSAADATDYLRSRLSEIASTGNREINEILASKKLPPEKLAEIQAVQMRCNADAANASRDAVDKMMAATQKILDADGVGGDARSWARANGFNTQEAPAPQQITAEDLHLGQGKSSTGPGVGGGMPSEPHSSGSDQALSNGSPGVGAAGFPGRPHTDAGVVPPSAGGPGVGGAGLPGPTAPASPVPAGAPSFSAASGTVPSGVPGVHGAPAAMAPSGLGLGQGGQPNLAQSFASGLATGQATGPGGQAFPANALQAMETGAPQTPAGTPPVAPTVPSAGAFIAATPPVDAPPAAAPAPSTAGGAAPVAPAVMTGGSWSSAATGGPSVPSGSLPAYGSDLRPPVVAAPSVPSAPTGPVSGAPVAPSPASSPSAGGTLVSPVERSAASAAAGQAGAGSSTLANASAVSATAGATAGAASSRAAEQQRLQRLVDAVARQEPRLSWAAGLRDDGTTTLVTDLASGWIPPHLRLPAHVTLLEPAARRHDANVVDLLGAVTVAAAHHANTYVAEPGSDEPTLSGDRPARSAAPQIDELGPTLVDAVRRRDGLPRIAQAVAAPAVRKTGVLESEIRMLRECTAEIQHAVLTAYPHHDPAAVGDWMLLAAIQALIDGHEYLAHYHLAWFQAINHRAGS

SEQ ID NO: 5785 - protein, 181 aa, Mycobacterium paratuberculosis
MVGDLPAGVGEGPSVHPPVGSRPPSYPWQPARRPRPWLAIALAVTAAVAAGALAIALIRPATRLPAATTLPKYTLSETAAAQKHLCDTYRLVAQAVATDTNANDRALARIADTNGALLLNMPADNLALDADRRDAAKALAAAYGTVTANNNSAVASDANYQAALDDVIAKDIAMKKVCGGA

SEQ ID NO: 5786 - protein, 188 aa, Mycobacterium paratuberculosis
MVGDLPPGPGQGPMTGPPNPTQWAPAFPPQPPRSRTWPAVALAAVAVLLGGAALVVALTRPTGGSSTASSTTSTTPSYTAEQTAAAHQKLCDTYRLAARAVQIETNGKNSDRANLATVNGAVMLEEAVNANPAIAPGDRAAALALAESYSNVAATSSVATGSDDPAWQSALDNANNKNAAMKTVCGGS

SEQ ID NO: 5787 - protein, 109 aa, Mycobacterium paratuberculosis
MFVDTDLLHSGGNQSHRAGGHARDGADQLAGGTVASGMFGDFAAADAFHSAVVVAHEQHVQNLQAHSETLTGVGTKAHHAANGFTNMDQQNATEMRALRPSSSPSPSNA

SEQ ID NO: 5788 - protein, 264 aa, Mycobacterium paratuberculosis
VLAWMGYDAPEFDDSHWEQAVTDPAKLEQVGTPWRARQAGVLLAGDVNGLAATHDAGSRAHVTVIGHSYGSTTVADAFANSGMRANDAVLTGCPGTDLAHSAADFHLDGGRLYVGAASTDAISWIGESGSGLPNGLNETLGGPLGPLAGLGTDPAHAGFGAVRFRAEVAGSHSVMPWFTDHSHYYDVGSEALHNMTEIVTGRGDQLAAEGMLAPDRDAARVSILGRVHTPLGTLSLPRVEIRMPVVVDPEWERPARSVTNEHGF

SEQ ID NO: 5789 - protein, 386 aa, Mycobacterium paratuberculosis
MQLRHLSIPFLVAEAGGDPWSIDSGLQAGRPAQIASLARAFHDAGISTAEADVAFTAARGRFEASWNHRNGAVPINDSAEVQRVTRALAVESRQLPRIATDLETIAAVLAESQRTSTWYIEALEYDLAAIDDEIGQALEEADHCAAEELRYSAVTETKAITLVLKQVRESYSRLLHSALARLQADGVDPADVRGVDELSIPPADTGPEQVKWWWDSLSDAQQRLLIDQHPQELGNLNGIPAEARDSVNRATMTDDLSKVEAVARVRGVSVEALRDNVLRNRDIDIFSNPASYGLCATDIVRYQNAVKTNDCLNKACDPGLPLMLWAYDPLAFAGKGRAGIAIGNPDKARNTAVVVPGTNSSVRGGWMSDGADDAINLYTQARRADP

SEQ ID NO: 5790 - protein, 169 aa, Mycobacterium paratuberculosis
VDYCLAGDGGAAAIWHGQPDLDLDGDGRFESIGLDFDHDGLRDDALADLDGDGLVDHAVLDLDNDGTPEAYFTDDGSGTWAVAVDRNGQLRWFGLDGVEHTGGPMVDFDGHGRPDARLVDTDGNGLADRVLRTDETGVTGYVDTDGDGKWNVRLTDTDGDGLADGASAL

SEQ ID NO: 5791 - protein, 480 aa, Mycobacterium paratuberculosis
VPDAAQDAELLTAAAVALNKHAPMLRELGSAFDAAGHQLYLVGGSVRDALLGRLSPDLDFTTDARPEQVQQILRRWADNLWDTGIEFGTVGVGKGDRRLEITTFRADTYDQVSRNPQVRFGNRLEDDLVRRDFTANAMAVRITPDGPGEFLDPLGGLAALRQRVLDTPATPEESFGDDPLRMLRAARFVSQLGFTVAPRVREAIERMAPQLARISAERVAAELDKLVLGDDPVAGIDLLVHSGMGEVVLPEIGGMQMAIDEHHQHKDVYQHSLTVLRQAIALEDDGPDLVLRWAALLHDIGKPATRRHEPNGGVSFHHHEVVGAKMVRKRLRALKYSKQMIDDVSQLVYLHLRFHGYGDGKWTDSAVRRYVTDAGPLLPRLHKLVRADCTTRNKRRAARLHASYDRLEARIAELAAQEDLARVRPDLDGNQIMEILGIPAGPQVGEAWRFLKELRLERGPLDPDEATAELLSWWRSRGNG

SEQ ID NO: 5792 - protein, 542 aa, Mycobacterium paratuberculosis
VHLRYISKAALIMFAGGDPWKINATLQSGRPAQISNLAKAFHDAGRSTGEAEAAFNLARGRFEQAWTHENDENPINGSAEVQRTTTSLRVQAAQLPKIGADLEKVAAALAEAQRSGRGEISTLEGALQDLDNQVGEAVELEKNPQLTASERQLLDHYIDGLEKHAIDDTKASVANLTRIRDQYSQQLHTSMDNLREQDSYDPPIQAFDGNVPESPSQDQRRHNQIEAFKQVFGREPSSAADWETAAALDSQTYDSKFNGAKSEIRVVRIRPVPGQGVVRVSQWIEQRDVTSSLTGNRDLGNNRGADQHFDPEDTKVTTYIDYENGLVILRQNPSVEETPTGAPGTVKVGTPKGSVTQLADGSVRIKYDAGNPFAPSITADTNGPFAGHTITVNGDLAFTPGPEGVHVNGTRTDYPSLEAYQDFPGGSTRTLLIDPAQSTSSVGPMFNLPFHHDVGPLGGRAFAPFDSGGWNLKYDVPAPLPATEFGPVTRAPSIPLLPSGVEVRPDRLLTGKLLRCLRSPAQHHSTPAPGAQQPGRHPLSSN

SEQ ID NO: 5793 - protein, 249 aa, Mycobacterium paratuberculosis
VSDGEQGKPRRRRGRRRGRGAATSSEKQTNGQLTGDSTATKPRRSRAARRAPDRLRTVHETSAGGLVIDGLDGPRESQVAALIGRIDRRGRMLWSLPKGHIELGETAEQTAIREVAEETGIRGSVLAALGRIDYWFVTDGRRVHKTVHHYLMRFSGGELSDEDLEVAEVAWVPMRELPSRLAYADERRLARVADELIDKLQSDGPAALPPLPPSSPRRRPQTHSRTRHSETRHSDKPATGRKNGHGPGP

SEQ ID NO: 5794 - protein, 800 aa, Mycobacterium paratuberculosis
VTAPRLCWAGGLRIAAVLGVLAGLAVLTGPVTPRAVAGEPGVTPFVRVRIDQVTPDVVTTTSPPVVTVSGMVTNIGDRPVRDVMVRLEHAGPVTASAGLRTSLDGDTDQYQAAADFLTVAPELQRGQEVGFTLSAPLRALTKQSLGVEKPGIYPVLVNVNGTPDYGAPARLDNARFLLPVVGVPPDRADDLGSAVAPDTSKPVGITMLWPLADRPRLAPGVPGGTIPVRLVDDDLATSLASGGRLDILLAAAEVATSHDVDPDGAVGRALCLAVDPDLLVTVNAMTAGYVVSDSPDGPAQLPGTPTHPGTGQATATEWLNRLRALAHRTCVAPLPYAQADLDALQRVNDPGLSNTALTSVNSIVDKILDVPSTRGATLMPDGRLTGRAVKLLGANQTTVAVTAADLSAGDAQGSSETSVDTAPRRVSPQVVAAPFDPAVGAALAGAGVNPEVPTYLDSSLTVRLAHDSVTARRQDALGSMFWHALRHDDTPRTQLLVPPATWNLQADDAQVILTALTTSIRSGLAVPRPLPAVIGEATQAAQTGAPPSDQVSADGSARGQFNDDVTGAITGQVGRLWGLTSALMTDDRTGLTGVQYTAPLREDMLRALSQSEPPDSRNGLAQQRLAVVGKTINDLFGAVTIVNPGGSYTLATEHSPLPLALHNGLAVPIRVRVHVDAPPGMNVTDVGVIELPPGYLPLRIPIEVNFTQRVAVDVTLRTADGMRLGEPVRLSVHSNAYGKVLFAITLSAAAVLVLLAGRRLWHRFRGQPDRADLDRPDPPDARHADPHDLADPRVEQEHRV

SEQ ID NO: 5795 - protein, 1188 aa, Mycobacterium paratuberculosis
MPGSPPTGPLPPVPAGIDRRRPELSDSALVSRSWAMAFATLVSRLTGFARVVLLAAILGAALSSAFSVANQLPNLVAALVLEATFTAIFVPVLARAEQSDPDGGAAFVRRLVTLTTALLIVATALSVAAAPLLVRLMLGRTPQVNEPLTVAFAYLLLPQVLAYGLTSVFMAILNTRNVFGPTAWAPVVNNVVALATLAVYALVPGELSVDPVRMGNAKLLVLAVGTTLGVFAQTGVLLVALRRQHVDLRPLWGIDQRLKRFGTMAAAMVLYVLISQLGLVVGNQIASTAAASGPAIYNYTWLVLMLPFGMIGVTVLTVVMPRLSRNAAADDTRAVLADLSLATRLTLITLIPIVAFMTVGGPAMGSALFAYGHFGDVDAGYLGAAIALSAFTLIPYGLVLLQLRVFYAREQPWTPIVIILVITAVKILGSMLAPHLTGDPKLVAGFLGLANGVGFLAGAVIGYVLLRRTLLPGGGHLIGVGEVRTILVTLTAAMLAGLVAHVADRLLGLGALTAHGGGAGSLLRLLVLALIMVPITAAVMLRAQVPEARAALDAVRFRITGRGPRPRKPAAPDRSSHRRPVTYPEQRNSSPPGVNAVQEPIRRRPPERANRARLVKGPEVTDRPMESAASSAGPGTGSGAPRPVADDFQPDIPADQPDRPRKADPRPADQKNGDVGTRRGPLDVPRERTADSSTDDVHLVPGARIAGGRYRLLVFHGGAPPLQFWQALDTALDRQVALTFVDPDRALPDEVLQEILSRTLRLSRIDKPGIARVLDVVHTGSGGLVVSEWIRGGSLQEVADTAPSPVGAVRAMQSLAAAADAAHRAGVALSIDHPSRVRVSIEGDVVLAYPATMPDANPQDDIRGIGAALYALLVNRWPLAESGVRSGLAPAERDSSGNPVEPMAIDRDIPFQISAVAVRAVQDDGGIRSASTLLNLLQQATAVADRTEVLGPIDDSPSPSTALISPGNDPATFARRRRNVLIGVGAGLAVLVAALLVLASIVSKIFGNVGGGLNKDELGLNGPSSSTSAPQTTTSTAAGSVVKPTRASVFSPDGDADNPGTAGQAIDGDPSTAWATEVYTDAVPFPSFKQGEGLILQLPSPTVVGQVSIDTPSTGTKVEIRAASSPTPAGLNDTTVLAPAFTLKPGHNVIPVRAGSPTSNLLVWISTLGTTNGKSQAGFSEITVQAAS

SEQ ID NO: 5796 - protein, 195 aa, Mycobacterium paratuberculosis
VGFGRNGNGDRSDAELLAAHVAGDRYAFGELFVRHQRHLHRLARLTTRSPEDAEDALQDAMLSAHRGAGAFRHDAAVGSWLHRIVVNACLDRLRRTKAHPTVPLEDIYPVADRTAQVETTLAVQRALMRLPVEQRAAIVAVDMQGYSVADTARLLGVAEGTVKSRCARARVRLAELLGYLDAGAHAAAEGAAGQA

SEQ ID NO: 5797 - protein, 232 aa, Mycobacterium paratuberculosis
MATAGNDAADHRNAESDPPLTAELLADLQAGVLDALNRVRREVAALGADPASPPDPPPQVTARVAAALRSAEPVGATPRAAHSARPPLRTARAIAAVAGLGAALAAIGVGTVALLRTPAPAPSTPTDIEHITVSTPPMQIPLSRAEILGLLDRSPDFGPLSDPARRASCLTGLGYPASTPVLGARPVAINARPGVVLVIPGDSPHVLTVYAVSANCSAADTGLLANTEVPRP

SEQ ID NO: 5798 - protein, 336 aa, Mycobacterium paratuberculosis
MTADTVHDVIIIGSGPAGYTAALYTARAQLAPVVFEGTSFGGALMTTTEVENYPGFRDGITGPELMDQMREQALRFGADLRMEDVESVSLAGPVKSVTTAEGETVRARAVILAMGAAARYLGVPGEQDLLGRGVSSCATCDGFFFKDQDIAVIGGGDSAMEEATFLTRFARSVTLVHRREEFRASRIMLERARANDKITIVTNKAVEAVEGSETVTGLRLRDTVTGETSTLAVTGVFVAIGHDPRSELVRDVLDTDPDGYVLVQGRTTATSIPGVFAAGDLVDRTYRQAVTAAGSGCAAAIDAERWLAEHAESSAAAQGDATEFPGSTDTLIGAPQ

SEQ ID NO: 5799 - protein, 117 aa, Mycobacterium paratuberculosis
MTDAEKASATIEVSDASFSTDVLASNKPVLVDFWATWCGPCKMVAPVLEEIASERGDHLTVAKLDVDANPETAQNFQVVSIPTLILFKDGQPVKRIVGAKGKAALLRELSDAVPNLG

SEQ ID NO: 5800 - protein, 406 aa, Mycobacterium paratuberculosis
MSSPRREYGDALRCGDRSAAVTEIRATLASLGLLASADEDLSTGRHVALELFDAELDQAVRAFQQHRGLLVDGIVGEATYRALKEASYRLGARTLYHQFGAPLYGDDVATLQARLQDLGFYTGLVDGYFGLQTHNALMSYQREYGLSADGICGPETLRSLYFLSSRVTGGSPHALREEELVRRSGPKLSGKRIIIDPGRGGADHGMIMQGPSGPISEADVLWDLASRLEGRMTAIGMETFLSRPVNRSPLDAERAATANNVGADLMISLRCEAQKSPAANGVASFHFGNSHGSVSTIGRNLADFIQREVVARTGLRDCRTHGRTWDLLRLTRMPTVQVDVGYVTNPHDRAMLVSTQTRDAIAEGILAAVKRLYLLGKNDRPTGTFTFAELLAHELSVERTSQMGGS

SEQ ID NO: 5801 - protein, 254 aa, Mycobacterium paratuberculosis
VSARITPLRLEAFEQLPKHARRCVFWEVDPAVLGNHDHLADAEFEKEAWLSMVMLEWGCCGQVATAIPDERSQAEPPCLGYVFYAPPRAVPRAVPRAQRFPTGPVSADAVLLTSMGIEPGPAADDLPHALLARVIDELVRRGVRALEAFGRTPAASELQDPRLVGPDLRPVLEAVGDCSVDHCVMDAEFLKDAGFVVVAPHTYFPRLRLELDKGLGWKAEVEAALERLLESARLEQPVGAASTPANALKTAPPD

SEQ ID NO: 5802 - protein, 328 aa, Mycobacterium paratuberculosis
MTQPLRKKGGLGRGLASLIPTGPAEGDAGPATLGPRMGDAAADVLIGGPAPQEASPVGAVYREISPADIERNPRQPRQVFDEEALAELVHSIREFGLLQPIVVRAIKESASGARYQIVMGERRWRAAQEAGLATIPAIVRETGDDNLLRDALLENIHRVQLNPLEEAAAYQQLLDEFGVTHDELAARIGRSRPLITNMIRLLKLPIAVQRRVAAGVLSAGHARALLSLEAGPEAQEELATRIVAEGLSVRATEEAVTLANRAGTTTPTPPRRKPIQMPGLQDVADRLSTAFDTRVTVSLGKRKGKIVVEFGSVDDLQRIIDVMAPPKP

SEQ ID NO: 5803 - protein, 367 aa, Mycobacterium paratuberculosis
MTSSGDWPVASSEAREGAATPAPDAPSATHTPAAPIGPGAPSGTRGASAVGSPAPPPTAATAPPSSAAASTSPPANVSRETADEFDTPIGAAAERAMRILHTTYPPLRRPKHRRVFTVANQKGGVGKTTTAVNLAAALALQGLKTLVIDLDPQGNASTALGITDRQSGTPSSYEVLLGEVSVHDALRQSPHNERLFCIPATIDLAGAEIELVSMVARENRLRTALADLDNLDFDCVFIDCPPSLGLLTINALVAAPEVMIPIQCEYYALEGVSQLMRNIEMVKAHLNPQLEVSTVVLTMYDGRTKLADQVAEEVRRYFGSKVLRTVIPRSVKVSEAPGYSMTIIDYDPGSRGAMSYLDASRELAERD

SEQ ID NO: 5804 - protein, 248 aa, Mycobacterium paratuberculosis
MFHVKHVGPVEPAAGDPEVPPVAELGAAPESAAALFGPRLATAQRYAEVLGTAGVERGLLGPREVDRIWDRHILNSAAVAELLGRGDRIIDIGSGAGLPGIPLAIARPDLEVVLLEPLLRRSEFLTEVVDELGLAVEVVRGRAEERPVRDRFGERDAAVSRAVAALDKLTKWSMPLLRHDGRMLAIKGERAAEEVDRYRRVMTASGAADVRVVTCGANYLRPPATVVSARRAKPPHPKSARTGKAGTR

SEQ ID NO: 5805 - protein, 195 aa, Mycobacterium paratuberculosis
LGCGPWMREIKTWQTPTPPNASSTPQRPPSRNRPTATRPTTWRSGLVAEGEIAGDYLEELLDLLDFDGDIDLDVEGSRAVVSIDGSDDLNKLVGRGGEVLDALQELTRLAVHQKTGVRSRLMLDIASWRRRRREELAALGDKVARRVLESGQREELAPMTPFERKIVHDAVAAVPGVHSESEGVEPSRRVVVLHD

SEQ ID NO: 5806 - protein, 353 aa, Mycobacterium paratuberculosis
VDLLFDFFSLDFVYYPVSWIMWVWYKLFAAMLGPSNFFAWALSVMFLVFTLRALLYKPFVRQIRTTRQMQELQPQIKALQKKYGKDRQRMALEMQKLQREHGFNPILGCLPMLAQIPVFLGLYHVLRSFNRTTGGFGQPHLSVVQNRLTGNYVFTPTDVGHFLDANLFGAPIGAFMTQRTGLDAFTYFSRPAVIAVGLPVMILAGVATYFNSRASVARQSPEAAANPQTAMMNKLALYVFPLGVVVGGPFLPLAIILYWFANNIWTFGQQHYVFGMIEKEDEAKKQEAIQRRAANAPAPGAKPKRNLKAGAGNGVDADAAQPDAGATEGQAGGGSDAPSRTPRPGARPKKRKR

SEQ ID NO: 5807 - protein, 115 aa, Mycobacterium paratuberculosis
VTGPARSGAAIRGAGRTVARGLIFLIQLYRHMVSPLRPATCRFVPTCSQYAVDALDEYGLIRGSWLAAARLAKCGPWHQGGWDPIPERPGCRVNCQDASDAWAVRATRGESGSLV

SEQ ID NO: 5808 - protein, 119 aa, Mycobacterium paratuberculosis
VLPARNRMTRSTEFDATVKHGTRMAQPDIVVHLRRGSEPDDESAGPRVGLVVGKAVGTAVQRHRVARRLRHVARPLLGELQPSDRLVIRALPGSRTVSSARLAQELQRCLRRMPAGSGR

SEQ ID NO: 5809 - protein, 47 aa, Mycobacterium paratuberculosis
VAKGKRTFQPNNRRRARVHGFRLRMRTRAGRAIVSGRRRKGRRALSA
